United States Patent 10,233,495 (METHODS AND COMPOSITIONS FOR SCREENING AND TREATING DEVELOPMENTAL DISORDERS) - sequence listing, part 29

SEQ ID NO: 266 - DNA, 767779 bp, Homo sapiens
  misc_feature (412280)..(462279): n is a, c, g, or t
acttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcatcattcttgtacacttctcattggccactggtgtatttctatagggtggaggcctggagagcagttgttccagcatagtgtttacatagcttttatttaattccgttttctttcctttgttgctttattagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttgatcgccaacgtagatcggaactcggttcaccagcgacctgaggacccggcccagaagagggagtgtctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtacgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaatggtacctggttttggccatgctttgagcctttattcattctgttaacttgagacggtatataagcctctgcatcccattgtgtgtttcactcacgtccatgtgaagagaccaccaaacaggctttgtttgagcaacaaggctgtttatttcacctgggtgcaggcgggctgagtctgaaaagagtcagggaagggaaataggggtggggccattttataggatttaggtagataaaggaaaattacagtcaaagggggctcttctatggcgggcagggatgggttcacaaggtgctcagtgggggagctttctgagccaggatgagccaggagaaggaatttcacaaggcaatgtcatcagttaaggcaaggaccagccattttcacttcttttgttgtggaatgtcatcagaacaggccatttaaatttcacttcttttgtgattcttcagttatttcaggccatcttgatgtctacttgcaggtcacaggggatataatggcttagcttggtctcagaggcttgacattcctgtcttcttatattaataagaaaaataaaacaaaatagtgttgaagtgttggggcgatgaaaatttttggggatggtatggagtgataatggacgatgtttctcagggccactttgagcgggattaggggaggtgtgggaacctagagcgggagaggttaagctgaaggaagattttgtggtaaggggtgatattgtggggttgttagaaggagtatttgtcatatagaattattggtgatggcctggatacggttttgtatgaattgaaaaaagaacggaataagacaaggagaaaaacaggtattaaaggactaagaattgggaggacccaggacatccaattagagagtgcccaagggggttcagcatagccctgccatcaaagattatttatttactttaagagggagttaagagtggcaaatctggggacagcaccaggagatataagctgtgatggcttggagaaacagagtaaaccgccagtttaaacaagagcagagcatttatgagtagttgagaacggtgaatagaagtatgactagacagaagatagtagtgatgacaagtttttgggggcacagtccaagttggtctggtgtctggaatgagactggggcctaataaaaaggaacatctatacaggagcttaaatgggctgtaccctgtagcattctgaggacaggcccgaattctgagaaggcaagtggtaaaagtattgtccagtcctttttaagttggtggctgagcttggtgaggtgtgtttttaaaagaccattagtccgttttacctttcctaaagattgaggaccgtaagggatatgaaggtttcactgaataccaagagcctgagaaactgctcgggtgatttgactaataaaggccggtccgctatcgcactgtatagaggtgggaaggctaaactgatgaatgatgtctgacaaaagggaagaaatgaccgtggtggccttctctgaccctgtgggaaaagcctttacccatccagtgaaagtgtctacccagaccaagaggtattttagtttcctgtctcgaggcatatgagtaaagtcaatttgccagtcctgggcgggggcaaatcccctagcttgatgtgtaggaaagggaggggcctgagcaatccctgaggggtagtagaatagcagatggaacactgagaagtgtttccttgaggatagatttccacgatggaaaggaaatgagaggttctaagaaacgggctagcagcttgtaacttactgtaggaacacaagatgactgctttgggggtagtgttgggtagctgctattgtgctaagggctgaaattgactgaaattacctacaatttaccaactgggccttcctccagaagttgcaagccatcagtaggctccagagctctgaaatatttacatcagacagatcctgcctgtgcagttgttgtctagattccaggtgcttctcattccaccatcttcccaggatacactctgagcttctggattttgaattcagtcaagctgttctgtaacagctggggtgaaagccagcaatgatcctgctaagaaagctccctggaaaaaaaaagttcaaaagtaacataaatatcaaactggaaagaaattgatttaggaaccaaacccaggttgtcatggtgaaaaaaggggcagaaccttagctactgaactgcagcctggggtacgaggtgacaaccattgcttttttagtttggtttggctagcaaaggtggccttgttatataaataaagcccctctggtagtcaaaacctttattttctctctctctcttttttttttttttttttttttttgagaaggagtcttgctctgctgtccaggctggaatgcagtggtgtgatcagggctcactgcaagctccacctcctgggttcacaccattcttctgcctcagcctcctgagtaaatgggactacaggtgccagccaccatgcccagctaatttttttgtatttttagtacagatgtatttttagtagagtttcactgtgtttgtcaagatggtctcaatttcgtgacatcatgatccgcctgccttggcctcccaaagtgctgggattacaggcgtgagccaccgtgcccaatgaaaacctttattttcgtgatggctgcttatttatttatttatttatttatttatttatttatttatttattaatttttctttccctgctctccctctttttaaatttttattatttatttatttatttttctgcagagatttatccaattcagaggtcttgtccccataatttggaacattcctttggatttgatcaagtcagatagaactggtcaaacccaatggggaaaagaaggaaacaacaataaaaacaaacagaaaacaaaaaacagttcagaaaattaatgatcgcacaatttatatgattgcttagcactctaacggtaagaagaaattatgatcagttggttgttaatcttttttatttttttattttttattttttttgagacagagtctcgctctgtcgcccaggctggagtgcagtggcgcgatctcggctcactgcaagctccacctcccgggttcacgccattctcttgcctcagactggttgttaatcataactttaatcatttaggagaatttcaagacaaaacacaggttcagttacttacctaggaatagggcccaggctgaagactgctctgtaccatcctagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaaccttagatctcgatcaaattttgggaaatcagggattctctggagggggtggatctctgaggcctcagcaaattttcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaagtatagcagccaggtgcaaattgtgggggcctggaaataattttggtataacacagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccactcgctgtttagccctgatttgcatatgagactttgtgctagtcatctggtaacttttcactcagcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactttgaggtgggtgaagattagagcctggattaatcaagggcctgtggcttctaacaccatcagttgcctgtactcagccaccttcagcagtgctatctggctctagagagccatagcattccaggaaaggaaagaagtctgcacaaagccctgatgtttgtgtccccccatctagacagacatagtagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcatcaatgaagagtttcttcctcattgaatcactaacacgttttggatctctctgacttcctagtttgctgacctctgacctctagatccagactttaaaggcccatgttattagattagtcaacctttataatctccccattttaaggttaattgtatctgcaaaatccctttgccatacaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgtattatctgagttcctttctcaggaaaccaagcgttgggccctccagatagtatcaaagaactgaaatttaccagagtaccacatctggacaatgaaatgtcagaccccttatcccatcaaaattgcctaagtgaccacctgcttcctgttgaccaattcctctttcttacctctccctaattcctgttttcctgtatgtagttccatttcttccctgctatctaaaccctgaattttcattggtcaggaagatggatttgagactgatctcccatctcctaagttgtagtacctgatgaaagccttctttcctagcaaagctagttgactcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagagtacaattataaatacacatgcatctaatagagcctcaaaacacaggaagcaaaaagtgacagaattgaagggagaaatagacaatttaacaatagtagatggagactttaataccacaactttcaatagtggatacagcaactacacagaagatcaataaagaaataaaagatttaaacaacataacctaccagacatctatagaatactccactcaacaaaaacagaatacacttcctctcaagtacacacaggatgttctatagaatagaccatatgctagcctttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccacagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctataattccaatgttttgggaggccaaagtgtgagaataacttgggcccaggagtttgagacccacctgggcaacatagtgagaccccatctacacaaacacacacacaaaaaaacacacacacacacacaatagctgagtgtgatgacatgtgcctacagtcccggctattcaggaggctgaggcaggaggatcacttaagcctcggagtttgaggctgcagtgagctgtgatcatgtcattgcactccaggttgagcagcagagctagaccctttctattaaaaaaaagcaaaaaaaaaaccaaaaaactaacatgcttccccagtgggggaaatatgtcagtataacattggtttgcagcaagaagtatattaagatattgaccaaaatccttttattatttattttgtttttattttttgagacagggtctcactttgtcatccagaatggagtgccgtggcatgatcttggttcactacagcaaaaaacacctggacccaagcttgcagtgagcaatcatgtctcactgcaagctctgcctcctgggttcacaccattatcctgcctcagcctcccaagtagctgagactacaggcacctgccaccacacccggctaatgttttgtatttttagtagagacgaggtttcaccgtgttagccaggatggtctcgatctcctgacctcatgatctgcctgccttagcctcccaaagtgctgggattacaggcatgagccaccgtgcctagccccatgcctggctaattttttaaatttttttgtagaggcagggtttcgtcgtgctgcccaggttggtctcaaactcctgagctcaagtgatccaacaaccctggtctcccaaagtggtgggattacaggtgtgaaccactgcacctggcctctaaatcgatataagtcaattattcacacactgagaggaatattcaggatttttttcttataatataaatgatgtggaaatctggagaaccaaagaagaacaccaagactatctaaaagtgttaaatttttcattaggaagaaaatgaattcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgctgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttagatacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacatactataaaatttacccattataattgtacagttgaataatttttagtaatttacccaagtagtgcaaccattaccataatccatgcatttgtttttaatttattatttgtctgggttctgattctacttccaccacaagcttcagcatggcagtatctgccaccacttgttttggtccaagggcagaaatgagcatcctggaaaccaatcagtacttgcgctctgaactggaaaagtgcaaacagaacttccaagacctcacagagaaattcctgacatccaaagctactgcctactgcctggccaatcacctgcagaaatgtagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggtgagtgtagtgaggaatagagactaaaaccttggtttaggcatgaaactgtctttcccctctcagcaatgaatatcagattccacaaacatgtaacatcactgttggttaaaacatctcaggattcgatttaaacttttttaagagcgcccatttgcaaagcactgtgccaacagcatcaggggtgatagaagtaatagtataccctatctgccttgaaggaacttaaaactagctattctcaactgagtcacagatatgtggagatgtgaacttcaatagcagacatggaaaaaagtctttatgatacctggatcaagattctcttcccacaaaagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacctgttactaatagtcagggaagggaagctgtaatgacaaggaaacatgggaacaagggcatgagaggaacagggatattagaagaggattctggttaacatagaaattgagtttgttttccaatttctacaattattttaaaatacatcattgtgtggggggtggctaaaagttgctgtctaacttactgtcatagaaaagtaaaaccaaaagcccacttattaaagaagtgaaaagatgagctttggtgtgtggaaaaactagtttaaaaaaaaaaccttcactcattataattgtaggaaaaaaatttctcaagctagagaagaagaaagatattacctaagaccctagtataaaggtattattgtgcagtgattaaaaagcatataccctggggccaaatttcctgggttcaaatctaacttatcatcactgtgcctcagttttctcatctgtaatggtaatagagtaggaactacctctttggatggtggtgatgatcatatgatgataattcttaaaaacctactgcaacagtaccatgacaaacactatgtgttggttctccctttaaaacaccacctattagcttttgggcacatatcatttggatctttctcctctatatacagttttacacagctgtatacagataaatgtttaaatctttgaaatattttgggattattgaaactcctgacacaggaggaccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtatggtggggcacacttgtaatctcagctacttgggaggctgaggcaggagaataacccgggagtcagaggtgcagtgagccgagattgtgccactgccctccagcctgggcaaaaaagtgagattccatctcaaaaaaaaaaaaaaaaagaaaagaaaaacatgtggcgtcagacctcaggggatgtgaattctgactgcctcattccagctgaatcatcttgtcaagtgactttatcaggcttttctttcctcatctctaaaacagggagtagttgagagactgaggaatacagatatggaaatcccagcgtaaagcctcgtactggggatacttttatccttgagatagaccctgcctcctgccctgcaggcagtgaccacagcagcatggccagccttccatgatgcaggcatgtctatcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagtagggcagctcaggctggtagaacaaagagcaaatttgtgcaaggagaagggcagaaatgtatgactcaggcacagaactagactaagacacaatgaggttatggtctagttaggtctctagggttttccattaaatagcatattagtaaaatggagacagctgtctgcattggaatactagcaatgtggcttctatttgtgtgtccttggtcaaatttacttcacttttctgcgtgtcattaaactaggctacctcatttataaaatgcaaatactgacagtatctacttagagggttatgaagattaaatgcacaattgcaagtagttagaaccatctctaacacatataaaactctgaacaactattttctgtaattattatatttgtccccatttatagatgtggtgattgtcattaatattttctataagagatattttcaaactttccaaagtgcctttcatgataacaatgtttctcctccaaactttttaaaaaagtattatactaggtggagtattaactggtagggctgttgggtagatagatgattgagcagctgttgtgtggaaaatgaattattaattcgctcaggaccagcattgactatccttagagggtttcagacataaggtagattgtcgcattcgaaacttcttttaatcctttgttgaaatgaaatcatagaagctcaaatttgtaaaactcaccaaagcagagatatttgattgaaggtgggataggtctggagcccctgtttctccccagtatgtgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgggtacatactaccgggtgctgtaagttgggtaataggtagcactatctttagactcacagagctcacactctacattggaacccatgtgtattagtccactctgacactgctataaacatatatctgagattggtgatttataaagaaaagaggtttaattggctcatggttctgtgggctgtacaggcttctgcttctgggcaggcctcagaaaacttacaatcattgcagaagtcaaaggggaagaaggcatggtcttcacatggccagagcaggagagagagagagagcaaagagggaggtgcacactttcaaacgaccagacctcatgagaactcactcactatcatgagaacagcaagggggaaatccaccaccatgatccagtcactatccagcaggtccctggttggattacaatccgacatgagatttgagtggggacacagagccaaaccatatcaccatgagaaatatttaaacaataattagaaaaaaaataaatccgcacagagtaatgaaattactactcagaactttactttttttctttttttgagatggagtcttaccctgttgcccaggctagagtgcagtggtgtgatctcagctcactgcaacctcaacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcatgagccactgtgcccggccagaactttagttttaactgccttcttactgattatagtctatcttcatgtcattcagaagaatactgcccctcttgaccttttcactgatttttctttttaactttcaattaatactagagataccggcccaacagttttgaacttggcttttttttttttttttctgccagttactgcatatgaaaaggtacatgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacactgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggagtcagaggcggaggttgcagtgaaccgagatcacatcactgcactccagcttgggcaacagagtgagaccctgtctcaaaaaaaaagaaaaaaagaattcaacttgggagttccttacagggattctaagagatctctcctctgaaacttctataacctattattcactacattccctcatacattttactcttctttcccaccttaggatacatgatcccttaattcaggctcaggctgaagaactgacccacttacaacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgccccaaagtggggagaaaaaatgcaaacttatctccattatagattttattttagttttgactatggtccttaatctgcattctattgttttctctttagagcactcaggtaatcacttttcatattctttctagaattctaagttttgttttttattttgagacagagtcttgctctcttacccaagctggagtgcagtgacatgatcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggctggtcttgaactactgagctgaagtaatccacctgctttggcctcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccactgtcttctggcttacactgttccaacaagaagtctgccataattcttatttctgtttctctgtacataatatgtcttttttctctggatgcttttgagattttctatttatcactcgtttgaagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaatttaatttatgtctttttttaagttcttctatgtaactcttcatcatttcatattttcctctagcttctttattttattttattctattttttgagacagagtctcgctctgttgcccaggctgaagtgcagtggtgagattttggctcactgcaacattcacctcctaagttcaagtgattcctgtgcctcagcctcctgagtagctggaattaccggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctctccaagctggctttttaatttttttcaggcagcataagagcagctattagtcaactgctattttttttcccactatggaggcaaaatgacctttaagaaaatagaccttattttttagagtagtttcagattcacagcaaaattgagcaggaagtacagaaagttcccatataccccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcacgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccgatgctaatctaatgccatcgttgatctgacaggaggctgagctcaggcggtaatgctttctcgctggctgctcacctcctgctgtgcggtcccattcctaacaggccatggaccagtgctgggggttggggactcctgttctaaccaatgctccctctattaaaagggattttcacactagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgtcttcttcaaagttactaccaggctctgcctgggtcctccctccctgctctacagttgacaatctcaggcagcaaactggagcaatcatagggctcacctcttttatttattatagtactgcactgtatccaatgttgaagatagagtttaaaatactttttccagtttctcagttgtttaaggtggaggacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaagaattacccccaacaacatctgaggaagcacaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcagccaggcaagtattctttgagctggggaacaaaaggcatttaaaactttttgctctgcttcaggcagctgacgtctggtgatgattcaccatatcaggaacaccctgtccagtgggctaaggcaagcctgccaggccacttctctaaagacacaacctgaggcctcctgcaataattctcacagagcattctgaacatacatgtaagctgttatgtccctgatcatatagggcccatgtgtgcaatgtgtgaaatgggacctgcttaatttctgactagctctttctaattttggtttgcagaaaatcacaatggtaagaaaaatgaagacaggcaaaagccactggctcccaggtaactctacatgatgaaggggctgataatggactgaccaaatctagagagaattccagaagcaaggactcaagaggttgaaggtcccagatctagaaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcattttacaaggtcaggagttcaagaccagcttggccaacataatgaaacctcatctttactaaaaatacacacacacaaaaaaaaaattagccaagcatggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaggttacgtttcatttccatatcattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatggtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttacagtctattggatattatggtgaagggcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttgaatcaacttcattcatcatggaagaatgttccattcataaacagattaaagagtaccttagatccatagaaggtgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgatcatgcgcttactctgagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcatatgcaaaagggctatgagtaggaggaaaactcaggcctctgaggtctcctgaaagagttttgctaatgtcacaactggctttctatgttatctgaagattgagatctccatgaagagtgaagataggtaatgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatacttgcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcatctagaggggtcttactggaagccttttactcagtccctttaatttccttgggtgtatactacggttccactgacatggatgacctggtagtagcgcagcagcctgaaataccagggtttccttagctgtggccttagctgctctttccaaaagggaatttcctctaataagaacagtgtcttccttctggtgtcccctgcagtgaatacttgttatttctttgggaattggacggcatctaaaagttccaagatctgagtaaagttgtatgggggatcccttggctcttgatagtcccctttccttccctatggttgcatgagcctgaagcacccggaaaccatacttagagtcagtaaacacattgactcttgagggtttttttttcttttttgaaacggagtcttcctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgtaataatccatacttcattatcaggggatggatgccccttggagccaaaggtctaaaaggatactggatttttctttttttttttttttttgagtcagagtcttgctctgttatccaggctggagtgcggcggcgcaaggctcactgctacctctgccttccgggttcaagcaattctcctgccacagccttctgagtagttgggattgcagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatattttttttcccatagataattaacactgggtttcaaaataacctggactgggagaacatttgcagttcttccaggaactaccatgtcacaagcagacgggtctacttgagaagtaatatttgatggaaggaacgtcttttctttatctgtgttaagacatgaacttagagctaggagaagtgtcccttcccagcctgtggccttctcttgaggtgctccaaattgaactgcagcctgttattgggaaagtaagtctcttcccagtaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggccccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccgagaagctcagactccgtttggagactgaggcagtctttcctccagtggccctcttgcttacagaaggcacactgattccagcctaggggatgatgagctggcttttgtctgggcatcccaaagccactcttgcaacactttctcaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagagcccgcccttccgggttgtctgggtctacattagtatatttcctgagtgcctcaaccaagcagccctaaaacagaatgggattttcatccttccactgagttacttctctatccttgtcacaattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatacttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtgggggatacaggctggagctagctaaataaaagggagggttttctgatgacattggggtgaaatcccacactggagaactggcaggacccctcgcagaactgggggactgagaagaccctggagagggcatgggccctccagggggtgccgctaggaagggagcatcgaggatatcccacgcggtttcttggtgcctggaagtaacatgagccagacacatcctgcagttgactcttaagtcagaatcctggtagggggccatagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagaagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaaatatttgggcaaaatgtttgggtggctgctgcttgtctgccactatgggtagttgtcacttgggccaggggtccaggaacccctggtccctgtgaccaagagttcaatatgggcttgagcaaagtcacgtaggagggggcccacaactggctgttatggaaaattgtaatcttttaatttaagggcggagaagatgacatccacactcctccagggaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcactaccaagtgtcctgccttaaacagttcttgactctgtcctgtcctgtcctgtgttatatcatgtcctgtcccatcttgttttgtctttgtggtcaccagatgatgcaaggaaggacaaccccaaaattggggcttagcccaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggttattcagaactttttggaaaagggatgaggagtttccagaagcatataaggtaacttcctggccattgccatggcaagttgacatggcatttataaactgtcatggcactggtaggagtgtctttatgctaatgagcagtgagggcaactagaggtagcttttgtctccatctgctggttttggtcagcttctttactgcaccctgtttggaccagatcctgctctgatcaactgggccacaaccgcaaaataagtcctgccactttcctgcctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacatatcattagctggaagctgcctctatccatatattaaaggtttctccatatgtagtgaactgtaacctaactggatgtgtaaacaacctgtaacctactcttgagccaatgactgaggtttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtattatatattatatacacatgtaatatatatatgtatgtgtatatataatatttatttgagagagagagaagtgacttgtggtactgatgttgcttgcctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcatgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccaggaccatcaaaagcacacctgcactaggtcattgggaactttggaggtgccttacatctgggcatgcattgaaccaccacacaaggtgaaatgcctcttctcaaagaggcttgcctgcagtttccactaacgaaattgtgagtcatagctgttcttctgtttgagatattaggagggattttgtggggggtgaggggggatgaaagtgagtttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaagtggaaagattgactgagcccagcaatttgagaccagcctgggcaacatggcaagatccccatccctataaaaatttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagcgtttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcacgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaacaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggacaccccactggccaacgggaccctaggcaaaccttataaactgagtcccaggccaagaaggaacgggaggccagacaagcctcattatattcccacccttttgcaatttagacaaaactgaccaacattaatgttatcacagagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaagtttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcattatctgtgggagagttactctgaaagcagcaagaagccattaccagatgcagatctcattctgtcagtaatggcaacccagcaaataggacaggagccccacccaggttggatcaatgcatggctgtataaccttgagcaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcaccattaactccccttcttcaccagagttttctggcacccaagactacagaaactctcctgcagtgggctttggggcacatcgcaagttccagtaacaagggctaagatcgcccgcttttggagaccttacaaagcatgtattccctgaccaggaatcgaactcgagctgcaggcggtgaaagcgccgaatcctagccactagaccaccagggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttaaactctctattgaaaaatgaacaaatgttcagaacagaggaagtagagtggtggcaccatcaaaggcaggaagggccaagagaacctgatgggagtggggatatagacctggttctagcttccagtcttccagtcactaactttctgctgtgtgcagggcacaatggaagtaaacaccacccactatatatcccctgtgcctggcatacagaatcattcatacatgttgaccgaagggtttcctttgcttctaggggattatgtatcattttgggaggaagcatgtattctgtgaggttgtttagtttatgtccaagtgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtactctttatcatatgaggagagtgctaattaatgtgtcatttattttgtgagcatgctaataaatatattcatattccaatttagtgaaaaaaaattgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttctatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagctgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctctctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccatgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatatgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgattttttgctgtgagacaaacttgaaaagttcacagacactgcctttctctgaaaactgcccttacctctttgttacaattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcctgtgtccttcagtggtgatggctctgaaacccttgtgttttatgaacttcatgccctggtcttcaaacgaattcagtgcaggccaagaagcacagtttggcctgggttggatgctctatattttcaaacagtgaaatgccttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcaggtcaggcccttcagcctggtggaagagcaggcagggagggtcctatggttcctgggaggacccgaagcatgatcacctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgtggaaccgtaaatgagggttcagcctgtctgcctgagggattgtgtttcctggcgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacacgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaatcccaagaggtagatgttgcggtgagctgagattgtgccattgcactccagcctaggcaacaagagtgagactacgtcttaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagaagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaatatatatatatatatatatatatatatatatatatatatatataaaaattagctggacgtggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaccgcactgaggggaaaagtcaatgtgaaattctacaaaagctgaaaattcactaccaccagccattaccacaaaaaaaaaaaaaaaaaagttgaaggagtcctccaggcagaacgaaactgacatcggatgaaaatctggttgtccaaaaaaaaaaaaaaaaaaaaaaaaaaaactagacatgacatctaatagaagaatatataattttaacatctgactgtttagctgggcgtggtggctcacgcctgtaatcccagcactttgggaagctgaggcaggcagatcacttgaggtcaggtgtttgagaccagcttggccaatatggtgaacccctctctctactaaaaatacaaaaattagtaaggtgtggtggcccacgcctgtaatctctgctactcaggagtctgagtcaggagaatcgcttgaacccgggaagcagaggttgcagtgagccaagattgttccactgcactccagcctatatggaacctagtttgatctggagggatcttattttataggaggcttggagggggaccttttgctttgtgtactcataggatgcacaagacacaagggaacaatctctcactttttaaatacagtgataggcctgaggagaaacaactgcaaattttttttttttttaatgagatgggattctcactggtcttgaactgagctcaggcgaggcttcccctacgtcggcctctcaaagtgttgggattaataggcgcgagccaccgcgcctgaccacaactaaccaacatttaaaagcacgtccctgggtaggctcgaaccaccaactttccggttaacggccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttccacgttagaaacgcttgcattgcctgactctgaaaccagaagggcggccgaatggccttcaccctccgttaaccctcgcctgcttcagaagccagtgcctctggaaatgcctggatctgcgaccccagcctgagcctagtagggcccaagggaagctgaacgccccgacggctctcatggtagctctttctgtttttttgcgccgccttcaggcaatcatctactccgcttgctatcccctcactcaactcggcttcagtagatggggttggtggggcgggagcgggaaagaagcaggggagtcaaaagggaaaacctgaaaagaaggagggagaagcaggggagaccaggacaagacaatgggacagcccaggatgccggtgcagagggcaccggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggggaccgggagcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgtgtcttttggtttgcctttaattcctgcaccagctgcggcctttatctgcagccagaaagcaggttttaccgctggtcccacagcgccatacggtctggggaaaagaaggaaacccaatagtacacaaacaaaggccaaaagagaaaccttccaagtgctctatgccttacggtttagcagaaaatatcaaacaactctcaacctagctggtctgtagcttccacaaatgaaatactgtattcattgcagcctttctggttgagatatttcaaatatttggtggagcttttaatgagacggagagacactctcgagtgtggaagaaaaaaatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctacagggacagcacagcgtcctcgccctggccggacgctcagggtcaccaccctacccactgcccccctcgccattcttccaaaccactctctgccaaagattccaccgacagtcaccccacacgacaacccaggccgcctttcagcagcggctcccgccccgcaaccacgcgccctctcacccccgcggttctgcccgccgcctctatccagtctgtgcacttcacctccctggctcccgctctcccctgagcttacagtggacgcggggttcttccgaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacagctcagcccgataggcacctccggggcggcgacggcaaagagggtgcccttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctagctgcggaggctgttctacatctgacccttggagcaggccggctgacagcgtagtaaaggaagatttctgcgggagggcggccagtgcaaaacaattccctgaccgggaatcgaacccgggccgtgacgctttcagcaccgaatcctagccactagacaaccatgcagatgcggaaagctgctttctctcccttcttcgacctgaagcgacactttcctgtgctctaggaggacttgggtcttgtgagagtcgctctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgcgaggcggcagcaactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcaccaattcgtgatttccgtcggccaagtgcgtgggcattgatctacacgtgagtttctccacctctgccgaatggctacttcggggtgggggaagggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttttcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcagatgcgcggtgcgcggggaagaagaggatttgactgcggttctccacccccggcgcctaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatgtaaactgggtggctaattcacaacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaatgggactaaatccagactcagttattgcaatgtgtgcaaaagaacaaggacttgtactatctgacttcaaggcttactataagctattatagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctccgttcttctgtggttagaagacctgaacccaactccctccccaagcactggagatggggcttttccaagggctagggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagttttttttttcttcttcctttttttctctagctaaacaagcactggccttgagataagcaatgctgaagcacttgcagctcacctattaccaaaaactgactgagccctccctacacaagccataactactgctttgattggacaagagactgatttcagtagttttctcttggtaagagaccactggccgtgggctggttctggacagtttacagaagctatgcacttgattgcctttgtgtccctgcttcaccttttgaagcatagggcctaattataatgtatttaaatgttgtctccaccccaaagtgaacatgggttgcatgtaacaggcgtgtttactcagcatgcatgcagcaggatcccttcacaaatattcagagctccccctattccctgttgaatatgtatatgtggccaaccagatcaacgtaaatcactattcgccctcccctccctggaaacttacttttcgggtttcagcaggaagctatgcctcccagtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcaaataggcctttgcaaaggagaatttcttatatgctggaagccataaaaaaatatgcttcatagtattgctcattaggcaagtacaaattaattccacactgagataccactaaccaatcaccagtgtgtggctacttttttttttttttctgagacagggtctctctcacccaagctggagtgcaatggtgcgattggtgcgatcttgagtcactgcaacctccccctcctgagtagctgggactacaggtgcatgccaccatgcctggctaatttttgtattttcagtagagacggggtttcgccatgttggccagtttggtctgagagcatagctacattttaaaaagttagcacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccagtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtggactaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctacaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcctggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccctccgggagcttcatttcttgttcctctccgtagtggctcagcggtaagcccaaggtccagcacacgaatcaggaaactgatggttcttgggttagcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatatcttttgctgctactttggtcagcgttgttgtcagtttaccttgtggtggccaagcccttaaatgcactattaggttatgcagtgtaattctgcagggcagaagggtaaagagccatagtgaagagcaaaaatacctcttatcttgaccgggaattaaacccgggtctcccgcgtgggaggcgagaattctaccactgaaccaccagtgcctctctctagcaaccctgggagaattatcaaaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcagtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagtagagagatttcttttctcaattttccctggagagattaaactgaagagaaaaattcagagagtttgccccacatgttgggtctgcgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctatatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaatagcgtttaagtttattggatactccacaagcttactgccactttattaccacacttttccatctatcggctcttgcatccattaacataagcagacaaaaaactggactcctggccgggtgcggtggctcaagcctgtaaccccagcactttgggaggccaaggcaggcggatcacgaagtcagaagattgagaccatcctgactaacatggtgaaaccccatctctactaaaactacaaaaaaaaaaaaaaaaattagccaggcgtggtggcacccatctgtagtcccagctactcgggaggctgaagcaggagaatcgcttgaacccaggaggcagaggttgcaatgagccaagaccacacaactgcactccagcctgggtgaaaaagcaagactccacctcaaaaaaaaacaaaacaaaaacaaacaaaaaaaaaactggactccctacagccagtgtagtatgcaccactcacttgccacactgtatgctgagtgacccttccacagcttaaatctgcacataacttcagcctagagccatataatgtccctttatttcttcagtacaatgattaataccatattctctgtacccttcttccctctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagctgattcacctccttggtgagggctctctccctggcttgcagactgctacattctccttctgtcttcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccatcctctgcagtcatcctgtcagtttccattccattctcctatccctggcttgctggttcaatactcttaagtgatttactgctggtgctcttctttttccctcagagataccttgtgatttctttgattctctccacctctacaggttaataagtctaatatttaaaaactctgtagaaggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaaacgcactgccgagaggccagaaggcaaagcgagagtcggtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagagctaacaaaaaaaaaaaaaaaacttatgtttccgcccggtttcgaaccggggacctttacgcgtgtgaggcgaacgtgataaccactacactacggaaaccacaggcggaacctgcacggcaaaatataaccatgaaaatcttagatcagccgtttctattatagtttccaaatccgagatcgcaccactgcactccagcctagacgacagagcgagagtctcaaaaaaaagttgggagaagaaggtgccattttccctagttgcttttcttactgcggtggtgaccgcattgccttcacacctgaagtccaagtgcttccaccctgcagaatatgcagaccgctgggtcactggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccaaaggaaaagcgcaaaggcggcccaaccccacgacctgagcaagccaagggtcgcgggttaaattgcgtttatcagaacagttgtttgctcactgtcccaaagccctcctagggacaaagaaaacactggcatggcaccaatcgcagaagggggcagcattgacacccaggaacaggagtggaaaagcaggaaaagcagggatcatctctctcctaccccgtatatggctgcagacatagcagtggttcttttctccaggacccagtgagtgtgcaccaggagagaaaattatgcacgttattcatggtggcaccacccaggctgaaagtgagcctgtgctgcttgggctttcaggaaggacggacccaactctccctccctatacagagctgcagtgccctggcaatggaggacagaccatggagttgcctgccctggactcggggaagaggctctgccctaaaccccattttagtggtagctgtcagagtggcatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactgaactgcatcctaaactggaccactgaattcaaaaaccctgctaccaaagggcttagtgctagtccatgagataagtttcctgagaattccgtaccctcagcccccaacaagggttagtgtgttagcttttacttccaacacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaaaattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgttggaaatgacagataagaattccaaatacggattgcaagggaactcaatgagatccaagaaaaagttgaagtccaatgcaaagaaatcagaaaaacaatacagaatatgaaagacaagaaaactatattaagcaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccattgaaaagcatacagtcatcagacttcccaagataaatgtgaaagaaaaaatcttaaaggcagctgaagaaaagggccagattatctataaaggaaatcccatcagactaacagcaaacttttcaacggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatataaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaggcatagggtggcaaattgggaaaaaaaaaaaaatcaaactttccatggcctttaagagagacctatcttacatgttatagcccccagaggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttaaattggactcttgactaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaaattgaaacaaatgaaagtagagacacaatgtgccaaaaactctggaatatagaaaaacagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcgagcagaactaaatgaaacagagataaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttgaattcctggaagcacacagcttcttaagattgaaccaggaagaaattgaaatcctgaacagaccaataatgagttatgtaattgaatcagtaataaaaattctactaatctgaaagagccctggaccagacagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaattctcaacaaaatactagcaaactgaatccagcagcacatcaaaaagataattcatcatgatcatgtgggctttattcctaggatgcaaggatggttcaacagacgcaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcaggttacaacatgagcatacaaaaatcagtagcatttctatacactaaaaatgctcaagctgacagccaagtcaagaacttaatcccatttaaaatagccacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcacacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagctgagatcatgccactacactctagcctgggtgacagagtgagaccctgtctcaaaaaaaaaaaagaaaaaatccccatggaaccaaaaaacagcccgaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaactaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcttatgactaagacctcaaaagcaaatgcaacaaaaatgaaaattgacaaatgggacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaattctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcgccacagccagaagagtgactctgagtatatgaatgaggggctacagtggactgtccagtacctagggagggagagacagggctgcaatgaagtctggagggatttaggaaattcattgattgtaccaaacaaaaacttacatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacacgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttccttctggaagcctgaaaactccagtttgcttccctgagcccttttcctgttgcacaactagggtgtggactacaggtcctacccatggaagatggaggtagatacttcacagggaataaaaacaacctagacaagtcatacctttaggtaacagatactttcaaagatgtactttcctgcacccattaaagttttagtctcagctaatctgaaaacctgcggtcctcatgcactgggatagcagtgcaatatggctcaggctcaggttttgctgggcacaccagagtaggccacacactctcatgtgcagtggcttcaggtatggatcagggtctttcccactaattggcttcagttatgatgttgtaggtcatcattcttctggctttaatatgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctccagcctctccctcaggcggtcattgagactgatggactcctccaggcgctggcgcaggttctgcatctcagcaagattcttttccagcaggtcggcccctactgcaaaccaccaagacataggagaggtaggaggtagggaagcctgatcatccctgggcagctgtggggcctgcctggcaactctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagagggggaacaggagagaagggaacaatctccaaggaaggaaaaagatgcacagagagaggaggctgagaataggcctcacccactgggagattttgcgtagggtcaggtttttctctgagaatttaaaatgtcttattgttacactacctgggacacagaaatggagctgcttcaagccattcctctaaatacctgcactcctagctgccaggtgccaggatgtttggctccaaatccaaaagcaatgtttatgggggcaggattggcacgtggttgtatgcacagtgtgtgtgaaagatgtgtgtgaaagagtggaaagagtgtgtaggggtgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtaagttcctaggtagggtggctaggagaaggcactttcaaagaacaagcactgagctggttctcactgtctggctgatctacatattgtcctgtcattttttatgaaccaggttctaacagaggaaccaaaaagtcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaatgagtgttttaaaggtaattatagtgagttgaatagtgtcctccaaaaattcattcagttcacttggaacttcagaatgtgatcttatttgtaaatgggttttttgtagatataataagttaagatgagatgatagtgaattgggggtatgtcttaaatccaacatgactgatgtccttatgagaggagaggagacacagagataaagagacatacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttaggcgtcttcatctccagaactgtgagagaatacatttctgttttaagatgcccagtttgtgtttttttgttttggaagccctcgaaagctaataaagcaatccacggaatgaagactaaggcagatgtcagcagactcatttcccaaggactccccatttcaccctaaagtaactggcatttctcagcctatgacataagcagtagtgttagttgtaatatctgagcatcacagcgcacatacaggaaaaatatggggcccctctcctagcttcctttatgattcccaatgctggaatgaacctggggaggtacttcagaaatgtttctcctaatagcaggactcacagccaatcctaggagttcagacagtgaggggtgaagcattttgttggtctgtaaacaggtgactatttattcaacattctatgcccttgccagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccacagaatagctagtgtactcttgcatagaggattgtagaatcacaaaatacatggcatcttacagctcaatgatgccatgagaacatggccagatcctctgggcccttcattactgtctccctttgagagaaaaacccagctggggtggcagggccataattcagagaaaagttttagagtctttccctttcaaggattattatcaagggctaaagaatagacaagtttctcctctgagcaggtgggagtgaggtttctgtttgccctcaacaacatcacgttcttttaggaactgtatatttaaatcagtaaccagtaggtctctccttctccaatttataaaatatcagatactaattagaatcactgtgagataaagagtaatgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacattctctggccataccacacggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaaccgttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttcagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaatccattatgggccgggcatggtggctcatgcctgtaagcccagcactttgggaagctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactctgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcctcttcccgtctctatcaaggctatcccaaggaccctctcagggaaattctcaggagggacacgctggttggtgatagactcagcttgaacctcacagcatggccccattcactgatggtttagagggtgttacagcaaacttattaggatgatggatgggatctgtaaatgcataaatgataaagatgatttagtgatgaacaaaaaataggaactgttgctgtttaccccagggattccaggattaggtgcacaatgttagcaacactcatgtccctagtttgaaagatgacataattgtgtgcagtgaagaggaactatttgccccctttctccccttcccaacccatgccccccaagaccaagaccatgtatgtgccagaggagatctagtgactgatggcatgtgagactgggaacggagaaaagctacctgaaaaccttggggcttatgctcagcactgagtcctggagctgtgcccgaccaggtacatcacggtggatctacagggcccggctgcaaagatgccacctcttggcctagacaatgcatgagcccccaaaaactggagccatgtggctactcactgactacagtcactgaaggatgcacttcctccttgtcaagctgtggagacgtgctgctcagggagtgatgtggggtagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctgagggctcacaggagatgtaaaggggaggtcaagaggatcattccttcagaggagaagccaaacaaatcatttctgtttcaggatagagtatggagggaaggcggggacagagagagcaacagttgtccggtgcattggctacaaacatcctgaggaaaaacgaagccgtaatgggccccttaaataacactcatgattccttcacaaaacacccagagacccataagagttcaactccaggtatgggcatggcggtacatgcctgtaatcccagcaatttgggagaccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcatgccactgcattccagcctgggcaacagagcaagacctcatctcaaaaataaaattttaaaaatgtaaaaaaaaaaaaagaattcaactcattctgtgaacataatttttaaaatagtatttgccataggccatttaaaacagattccccaggcaatgtagcctcactggtgtcttgcagtttctagatctccttccctaagtatagagacacagtataaacttttgtttgcaagaaaaatttgtagccgttttacatcttccagcgctccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatcactaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggaccagagacttgactacctgatgcttgccttgattccaggatactctgaattttctcagatcttgggttgagtctttagagagcttgtctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgttccttctgtctttctgccaattagtttcagaggaataccatcatccctggggatgcctcctgccctaacagtcatattccatgagggatggaggtgctggtgatcatcatggcatcctcaacccttcttcttggagctcctctccagccagtcctgactctgtcatggtcttaaggtggtgattacaaagcaggacaccaggttgaaaagtgacatgtgaatgggggtggcatcctgtgaacttaggaccttgggagagactgaaaatcttcctaagctctgcggccaacttacctgtgctgaattttctggcaaggctctctgccagctggcttcctttggccagctgctcgcagtagtgctgctccatatagtggtcaaagttattgctctggagtagctcctcaaaggtctttagtgtgttcttgacatgctggatgagaagagcagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaatctctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttatctatgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaggccgggcgcggtggctcatgcccgtaactccagcacttagggaggtcgaggtgggcggatcatgaggtcaggagatcgagaccatcctggctaacacggcgaaaccccgtctctactgaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagaggtcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaatagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatgtttgacaaagggacaagggcaatacaatggagaaaagatagtattttcaaaaaatggtgctggaacagcgggacatccacatgcaaagaaagtgaatctagacacagacttcacattcttcatgaaaacttactcaaaatggatcataggcctaaatgtaaaacataaaatgataaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttacttgttggagggcatgatcatggctcactgaagcattccttgggcatgatcatggtgtgattatggctcactgcagccaaactcttgggctcaagtgatcctcttgcctcagccttccaaagtgctgggattacaggtgtgagccaccgagcccagctatatgattatttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagatatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagtttacacaaaaacctgcacatgatgtttatagcagctctattcataactgcaaaaacttggaagcaaccaagatgtccttcagtaggtgaatggataaattttgatacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagagagtaaaaagatcagtggttgccaggtgttaggaggaaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtgggttcatcagttgtaccaaatgttatcactcgggggcaagatgttgatagtgagggaggctgtgtccttgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattctaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgttttgtctgagatggaatcttgctctgtcatccaggctgaagtgcagtggcgctatctcggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgtgcctggcctagcgttattttagccctaactaacattattctctgggtcagtgaaatttaagtggaatatattgggcagtgacctaatggagcatgaagcaggatttgaatcacttccaaagctgtacaccaaccacttaggcaaagtagtgatttcagtaacttagtatttcagtaactggtgctcacaggcaaatgcgtaatggattaaccccatattatttaaatgcttccaaaaagctataggaaaatggccattaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacgtatgaagaaacaggagattcctacatgctcctggggatccagaagagagaccactcacatgactggaagatttccagctcaggtaaccacaaaggccatatatttggtgaatacaggcaatgttagttagaataaaaccaaatttctctgaataatataaagtcattactaataaaacttttatagatttttctctgaagaaatttccaggaaggtgttaagagaaagccctacaattaaggtatggaggctggctgcaggccctgaaagctgctctgatgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcagggtgggtgctgttatgagaaggaaggggaggtcccacaggtgtttagaagaaaaagcaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttgagatgccagagctcaaatcccatgtcactgggacatcaacaatagtgctatggggaagactcagggtgccagctcttgagtcacaatcacagaattagaatgtggaagtagctacagaacccaaggaagccctgccttctgatagctacactcaatgcaaggctgcgtatttcaccctggaggtctctaacaggggaggccaccccctcaatagccagcttttttacccttttgcttacgttgtcaaccaatttctaaccacagcaaaataacctaagtatacctctccttgaaaacatcaaaacattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtattactttttaatacataataaataatatatcccaatgcgatacttgcttcctttcccttgcagtagcaacgtgtaggggtttcatttaatatgaggtcgatttgagccttccaaactcccattccacccacctttgcttgcactcatgggaaggctcagtctatatctggtttgcccacattcctaggctacagacctctaggactcccagtttgagaggcgccatttttttggagggtagtgaattttgatttctgtctcctttgcatccttcccagtgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacacgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaagagaagaggccattggtagtatatacttgcatttttcttgtaatacttgcataagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattgtagggaatgttaaaatttctcactggtacagttagaaatgaaaacaaagacaataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatctattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggatatatactcaaaagaactgaaagcaaggattcaaagagatatttgtgcacctgcatcaatagcagtattacaataactaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggacattatgcaaagtgaaataaaccagtcacaaaaggaaaaatactatataattctgcttatatgaagtacctagagtagtcaaagtcatagagacaggaaataatggtggttgtgccaggggctagggagggaagaatgggaaattaatgggtatagggtttaggaactttagtctaagaaaggagaatattggatgccagaaattcagttttctttctgttccaagatccctttagctagagcgacatattgaagtcagagttcctaagggaaaatcattgtgtatggagatcatccttgtggatcaaatgtgaatcaatagtagatcaaaagatattccacttttgcagatattgacatttgttggacccgtaagattttatctagtattagatagataagatgtgaaccacttctcaacgctgcagactcaaatactaggaaatactaagaacctcaggacaaacaaatagccagtccaaaaagactcacagactagataagctgtcatctaccacctaacagataatgtatccctgttaaccactatctccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataaggtgcaggattctattagctaagattatgtctcaggtgggcaaatctctgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagtctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatacaaaatatcttggaagtttagctgaagagatgaggagatactctactgctcaatgtgcgccatgtcatctgttgtacctccccttagttaagtcaggagggcaacactccctttattttttattttattttgtatgtatgtgtgtgtgagatggagtctcactctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcggcccctctatttatcagacagatgtatagaaagtttattgtgctagcaagagtatgaagaaaaggattctctgagttgaaaaaacaaattggaatataaattggtaccacttctatggaaggcaaatttacagggcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgatcgagcaattagtaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactacatttctttccaacagagaccttcttggaggatgagaagcagccactagttgacaggaggggaagtgaggcatgtagtcttcaagggagcagaccaccgtgggagttataaaagaccagcgacgcctctgggtgggttcgaaccaccaaccttttagttaacagccaaacgcgctagccgattgcgccacagagacatggctgagctcctaatttcgttctataagagggtaagctgtcactaaacgctagctagcaccatccgccttttgcaaaatgactgggtaatctccaaagcctcggaaagccggagcagtcagagcgacgaatctacttgtttgtcaagtttgaaacctgtgcattgagtgattccgaaacgccccgcaccccgccttgcctgcctcagaagccggcgcttccggagatgccgggatcgcgactcctgttagagcgacttgggccccagggaagctgaaacgcccagggcgctcaattaggacttgttgaattaataatacatttgagagacagaatatacaatcgaacaatggccggactatacgtaaaaatataactctgatccacaacctggggccacctgcccaagaaatcaacttccttatgtacgaataaacaaccggggaagccagcctgctattatataagtcagactcacagggagccaggcagttatctgtagtaacaaacaataacatccataacaatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgacgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctagtcaattgatttccaagtgtgcaatgtcccatggggtaggccacaaagaggcctagagtgcaccatctgtgcggctgcagctcctggctctcaacagaactgagatctaagtcctcatgatctgatcagcttccaagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcctacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatatttttgcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacgtaatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcactgttctagaggctgggaaatccaagttcaaggtgccagcagactctgtgtctgatgagggctcactctctggttcataggctgtgccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagtggggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagtcttaacaaggcttaccttctttcttgtggtaattttttgataagcagtttttaattttgatgaaatccaattttcttattttttgtgacctctaagacatctttcctaccctatgattgtgaatatattttcctacattttcttccagaaacgtgtttttatttttatttttaaatctataattcttcttaatttcatctcctgatctcagcacaatgcttaaccactataaaatccacaacttgcagaccaacagttcaatctcccagaaacttgtataacccttgatgtaacaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcgatctttcttctgtaaaatggggctaataagagtagtcttaggccaggcgtggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggcggaggttgcagtgagctgagatcacaccactgcactccagcctgggcaacagagcaagactccatctcaaaaaaaaaaagaaagaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtttccatttctaatactgaattgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattgctttagtaccttttttgaaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacagctcaataaacctgaaatgtgtacatcctatggtgccaccatgaaaatcaagacatgctgtcacttaatcgctctcatttcactagaggacacatgagctcatgaataacggttgaccccttagccaaagatcctctattgtaccctctggagaaaataaatctctagttaccttaaaagctgatctagaggtaaaatgtctgcaacattcagcaatgaatttagattatctttgaaaaaaagttcattttcaagttgttttttttgtttcgtttttttttttttttttttgccaaagaatttctttttttttctgttacttagtagcatgaagtacaatgtttggtttgcaatttctgttctttgtaggaagaaaaactttagtggaaacaaccagtacttaaagaccattttatgaggctgtcatttacgtattatctcttttgctgtttttgttaaaatgatataaggtgggctttatatgctttctgtatatcctttggaatgtgtatttaaattaaaaacttaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttcctcccacccttgaaagtcctcgacttaaaacccatctagaacatttcctttgctaagactttaaagtattctttcttcaagttaagggcagtttttaaatagttatcagttgcattcttggaattcacagaaagcttggggagaaacaatccaacggcacaagttcaagtgcccaacggggtggagaagggactgcatactcactggttgccaggccgaggttgtccgccttgcctgctttggctgagactggagacggaaactccattcaacagcgactggaggactgaaacagggcgcaagagggcggctgcccttcacctaccggtccctccctgccttggcgccttcggagttcggactgacccgggatgttgctggagcccgcaggaactgcaaactcaccgcgcgcgtccctgcacacccgcacctgcgcctcgagaactcctggccagttgaatacccggtcccccgccgagcttcgctgcaggtcacaggaaagaggtgcagggttgcgtacccggcgggagaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggatggagggagggaagaaagatgaaaaaatcaaccaaaaaaagaacatgatttcctaactaatcggatgtgggtcatgagagaaagacctgcgtcgagtttttggcctgaacgtgtggagggtggagttgccattaactaacgtgggaaaaggcaggtgtagtacgttttagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggcgcatctttaggtcggtagtgaggtgcggccgggacgctgcaactcgctccgggacttgtaaacctggcaggtgttcgaagagggccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtaatttctgctgaaacaattgaaggaggaaaaaaaaaaaagtatgtgctttgtggttccctggtagtctagtggctaaagtttggcgctttcaccgccgggactggttgattccagatcaggggactgggtctcggcctcactgtgaggtattgttctttcctgtgtttgccatctgccaccgctgtggctcaattattccaagactgctggagaaatggaattaatgtcgatcctaaaatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatagtctcatgggtatgcttgagactttaggcccttgggacacctggtgcacagaagggtcccaaaacccatctttggaagtgttggcagagtaaataggcaccagtaataaaggcaacggcgcctgaagacctaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttattggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatgtatacgtgtgtgtgtatatatatatataaccatatgtaatttcaaaaggtaaattaaatataatgggacagtgttggtaacctcttagatagtgtagggctaagatagctgaatttatggcatggtgttgtatacttcagatatctatgctgtaatattaaaatggcatttccttggcccactaaattgtccatttcctggcccaaaaagatacgcgaaaggagtgaaaatgggaagaaaatagccttttgaaggacttgcctaataaacttctcccttagcattacttggagtgacatcagaaaattggaatgaagtaattgtgtaatgtaaaaaagacaaattctctgctgtctttctcccccaatccttaataaacaaaggaggaaacctagactcaggttaggttttctcttcttattctttacataccaggacaagtactgagcttgtttgttactatatggggacttagtatattgtacaaaggggtgtggctattactatcccttttctaccagagcatcaaaactggtaacttggctggtgttaacgggagcttctaaccttgaattcccactccatgtgacttctttctggttctctcttctcagagaacttgcagccatcagattcatttggagaagtttgataaaggttactttacgcttagacagaagaaaaaaccctaaggtcttgaactgagccttatcctctgatacagtttactggaattccctccactgtggcacaagccctgctgtaaattgtgattatctataccttgtcagttttatctatgtatatatcttttacagtaatccccacatccaccagagaacctaggttattggcagaatgaggtttgggaattctggtcctctggccagacactatcagttagtactctgattccaccatttttgaaattatatacaacaaattttaagtattgtttattttggagagttcaggttaaaggaaatgaagactattattcagtattatttctgtaattttgtaattttaaccataacataggtttcttatcaaaacgtatggaagccagaaagcagtgaagcaacaatattttctccaaaacgaacaggccaaactttggcaggagtgacaaatctggcatgcaatggtggcttctatatcagaaatcaagtcttttactttgtgagagcacgagtttttagttttttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgccccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagatgcagtagagagacttctttcgttaaagtacctgagtcaggttgaggggaagagaagaattaggagcacaaagagagcaggcacaccacaggaagcacaactctgcaattgcttttggttttaagaggctgtccattcagtttttttgggttttttttttccttttcttgaaacggagttgcccaggctggagtgcagtggcatgatctcagctcactacaacctccacctcctgggttcaagcaattctcctgcctcagcctcccgagtagctgagattacaggctcctgccaccatgcctggctaatttttctatttttagtagagatgaggtttaaccatgttggccaagctggtctcgaacccctgacctcaggttatccacctgcctcggcctcccaaagtgctaggattacaggcatgagccaccatgcccagcctgtccattcagtttcaatgaactttaaacaacaaaaaatgccatttgggtggctggtttcagtcttccctgtcaatgctcagcctccaaatattcactaacacatagaacaataggaggactgttactctcctctcacacctactacttgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacacccataattccacagcatgacaccaaactggagttactagatgacaacccaagtggtgggttgctctgtcaagaaggggccaattttatattgcagctaggcagttacagtctgtagctgtaccattgaggggatcggggcaagatgcaaatttccatggcttaccagaaacaggtgagaaactgcctgctggtagcctgctgcaagacaaggaggcccccaaaagagatgagtaagaaatagtcttatgataatggctcacaagactacttcccttaccatggtccaggagggcatttggtcaaggtttgagtcatagtatggttgagccttgcctatgtaaagtttaagcaaagccattcccttgtaccttgtaccttgaagagagtttcattggatataatatccttaatttgcactttcttctttttaatgagtaaattgcattttattttattttattttattttattttattttattttattttattttttgagatggagtctcactctgtcgcccaggctggagtgcagtggcactatctcggctcactgcaagctccacctcccaggttcacgccattctcctgcctcagcctctggagtagctgggactacaggcacccgccaccatgcctggctaattttttgtatttttaatagagacggggtttcaccatgttagccaggatggtctcgatctcctgacctcatgatccacccaaggagtctctctccctccttgtgttctggtctgtgaatggctcacacttgaacttagtgtaggctcctagtgggaggagcaggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactggtggaagcctcagggcaaggccttcacttcccagtgacactgttcccaattccctccagcatgagctgagcctcctcaggctgtggttgtgcagcagacagggtgtgaggaaaccctgctcaaccctggttacccaggatggcactgagttctaaaaagcaaaggttatgtggtgaggggcctggctgaagacctggtgtggtacttttgtgagcagtggcaccaatagaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaaatacccaacgtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagctggccacccaaccctaatcttcttcttatgcaaatgggttttctactttactcgcaccatgttgtctgctccttactgtacacgtggttagaaaggaaaagggaagatggagccaccatgttgaacatgcctaccccccaggtagccttgtcctattggcacagccgccagcagtcacctgtgcaagcttccagcttgcttatctatgtctgcagctccattttacaggctgctttttgttagaaaagaaattatttggtggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgtcggccttgtaggtgtggggtatctctagcaccagaggatcattgaggttggggatgcagggcagtgagcagatggacaagagaacttttgacagtcaatgctggagaccactgagaccataggatgttgaagcagatgctgccattgctattgatattggggtgataaattttggttgtgaaagcaacctttgggggcttgaacaggcaatccataggaaagtggatggtcaggaagaaaacacctccttggcaaggactgtcattaattatcacccagaggccccgtggagcactgggcaggaggattcgtctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgcttttgtaacttgttccacagtgatgcctggagacctgagtatgttttatctttaaaatctaataatgttactaggatattgtcttgaagttgatcatcctggtttaatttttgctgccactttatgggctctttcaatgtgcctcatcacataagtaatgtcattttcatttttgtaaatcaagtctcctagattgttcacctgaaagcctgattctcctttagagaaaaaaatgctaaaaaacaaaacaaaacaacaaaaaaaacaaaacattatatatcgcattacaattttattcaacaaatacagaggtttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggagagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaattaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttcctcgctccatagtgaggcgtgacccagcggtcagcccaaggtctagcatgcgaatcagggacgtgatggttctttgggattctagggatctacctggagaatagatgaaagtaacaaaagttttacataccaatattcaaaactgcatcaaactaccagaaacacttgccactttcaaagatagactatgctaagtagctccaggtgtgtgccaccatgcctggcaaatttttgtatttttagtagagactgggtttcaccatgttggccaggctagtctcaaactcctgacctcaggtgatccacctgccttgacctgccaaagtgctgggattacaggaatggctcttgactctaactgcaaggtccctagatcattagatcatttcctgaatatcttatgcttcaggcattggccatcacttgggttaccattgtcataaatcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccacaaatccggctcttatgtgtggtcctggagaaacaattgaaatacaatactgaaaaagacagaaattgttccaaaagaagctttttgcagtattgactaaaagctaacagtagacatccaaaaccaaggtttttacagaatacttttactagacaaaactataaatattaaaatagcttatttgatcaaactttaattccgaaaaaggctccttccaactgcgtaacagactcctatagaaaaacatcagaaattcatccaggttccttgtttctgatcctaaatcttcaatttaggacctcaacctcaaactgttgctttagtggctctgggaaggaagcactaactggcagcataggtaagtaaagttttaatctagggaagaaataagaagcagaatcagaattagaattagaagaaagagggaatatgctataccagaatatcataggcaaaaaaagaagacaaagaaagaggaaatgaaaggacagaaggtaatgctaatggagttagttatttgtggccgttttttgtaaaagagtaatgatcagtcttgtaatcattataatactattatttgctttctaaaatgtctaaaatatttgaaggaatttatgatataaaaagatgaataatgcttgcagtcagtgtttcattgtttgggagaacccagtttcctcagttaatacactttcgtgtaatagctgtttaaggagtaacatggtttaaagacatattaatggctgaaatattaacatattggtcttttgatgaagttcaaatagagagatttctttccccaattttccctggaaagattaaactgaagagaaaaatctggaaagtttgccccacatgttgggtctgggagtcattatgattttttcaaagacaggagttgtgtatgacatggaatcatgcttcttctctagttgagaagccaagctaggtccaggctgagtcataaacttgaacccaacaaggaaatcacccttcacactggccttgcagagctttggctcaatctgttctctgcccaacacccaagacacatactagttctggccaacaaaccttcacatattgtctgtgtcaaccagagctacatttattccgaaatctctttctaaaatacaaacctgtactttctactctcaaccccaaaatttacaagaggcctcatatgcatctcagagtcacagatgctaaaactcaacacaccagtgagttccctgtcagcatcatatactaccctctacctcaatgatcagccccaagccagcatctcccaaagagtagtgtgttgctgtgggtgtttcaacagatcactaaaacctgcttctacccctgcctagacacttatcctcactgctatgcatcctgctcctcaaatcagatcttgatatcttctttaaacactcccaatctcccaacacgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtatcctgagtgacctttccacagtgtaaatctggacatacctgtagccttaaatcatatctaccaacatagtagccaagcaacagcaatctcttttcctttggtcattagagtcctagagaccaagaggatgttgggaaaagaattaccatggatcagctctcagaggcagtaggttctggactcatgctggctttgatacgtgtgcattggaaaagctcaagtacctggcaatacttggagattaggaagaaaggatgaaaataaaccactgcactaaataacatgacaataatcacttatacaaaaattttaaagataaggaatatttaaagatttattagtttattatagctttatagttggagagtgaagaagaaaataccaaagctttttgtcttaacaaaatggtgcagacagattaacatatattgtcacctatgataaccagtcagcataaaaagtatttagaaaggaatggttatattctctaagagatatattctgatgtcatgttttttgctttagagtctattaatatagccacctttttgttaatgttttcagtcaagctccttttctcgcctttcatttccaacctttctctcactttctggtttagatacaactcctaaatatatcatatagttaatttaaaaatccagtgtagcagtatttcgggggtttgttttactggataatttggtccacttacatttaatgtaattgttgatatatattaattttaaatctaccatctttatttttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatccttaatttttttttttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtaataattgataccgttatcctcttcctgcacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttactctttatttctgctatgtctctgaatttccatatgtaatcatggtccttctgcctgagaaacatcatttagaatttccttttgtgttggtctgcttgtgaaaaactgtttcagctatttttctctgaaagtgtctttatttgctttaattattggagattatttttactaagtatgtaattctggaggcagttattttctttcagcatattgaagatatttacatttgattgtttcttttcagaaggcagccaattgtctcgctgctgcttatttgaatgtaatgttcctttttttcctctgttttttgtctttactatttttgtctttgtttttttttttttattgtctgcagttttactactctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaagtagactttctcactctatttgttatatttttgtgtttgtgtattaaatattattttttctccttgttatatattctgaatttttttcttcttcctcatctcccactttactagttctcttttcagctgtgactgctctcctgttaaactcttccattgagctcttaattttgttttgtttttttttttccgaatttctgtttgcctctctctaaatctattctgtcatttttttgttgtttccaattggtgtgtaaattgttaacaaaacccttttctccttctgcatgataatttgaccttaattaactttccagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctgatagcaagctataattcttatcctacatctctcggattaatctggtgccaagtatggcctctgagattcttgtgagcctgaacgttaacttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagttcatttttatcccaagattatagaaatgtaaggtcctaccttattgtaggattattctcctgataaactccccaacttgggcagactctggtcttctatttctgtcccattagtcacagaaggctgtcaaaccctaatatgcaggtcaggaaatgtccttagccaaaaaatggcttctctgcttgcttacggctctgggttccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgttcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatttgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactatgctgccaaagtgactcaaactcaaaaggacaggatgagacttactcagaacttcgaggaagtgtagagaaattatccaccactttttatcctagaggtgcttttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaagagtcaagtctatgacttacaagcttataaagatccctcagatgagttatgtacatggattgagaatcagaaaaggaaggatgctctctcaggagatagaaaaaccagataaaaggaacaactgaaattatctgacccatcccctcatcgcctgtgtagaagggaaatgcttactttatctaaccagtggataacagacagcctctttcattttggagctaccaaaaagaaaaataaattgtggtttggttcagttcccttttgaccagtatgttcttgaaatttcgaaaacattttactctttttccttttagtgtttcagtgtggataatttcatttgatctattttcaagttcattttttaggccaaaatttgtcaaatattggcaatttcatatgattcaacttaatatattaacctaatgtgccaaattcaaatttgtttctatactactaaataatatcccccgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttatttaagctttatatatttactttttacctgttaattgttgtaatcacccactaaagagtaaattctggctgggcacagtagcttacgcctataatcccagcactttggaaggcccaggtgaatggatcacttgaggccaggagtttgagaccagcctggccaacatggtgaaaccccatctctactacaaataaaaaaattagctgggcatggtgatgcacacctgtgatcccagctacgcaggagactgagacacaataaacgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtatcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatgtaggaggatgtgtatgaatgagcatgtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcctttcttacaatcccggagccagcctcatggccccctctcaaaggcatgagcatcagccagtggacacctcttcttcagagatctgagtccctgcgacactaggtacttcctctgagttccaaggccaccagcaacctccttctcagaagccatcctcccagttatgtgtggcccttcatccaagttaccaagttctaacaacccaaccattttacctttgtttctacaaccctagggttgatcactgcttcgctttctacacttactatctctgtgttacatcagttccccttttgccttcttagacctccaatacctgtataattccttgtgttaaattccctctggtatactgttcattttctatttttttttttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgatcctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaagagacttgattaactcacagttcagcatggctggggagccctcaggaaacttacaatcatgacagaaggagatgcaaatacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttcccaaaagtcccccaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagagattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactatcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagatcttgtcctctgcacacctgcaggaccaacaccatgtgaaagctgccaaggcttggggctcgcacccgctgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagacactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagactgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaaaccccttataaaaccatcagatctcgtgagaatcattcactatcatgagaacagcatgaaggtaactggccccatgattcacctacctcccactgggtccctcccatgacatgtggggattatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttgtaaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaaagaaatgaaaaagcaggaacacatgatagggtagtctgagctctgtacaaataggaacagtaacatagacaaggagtaattagagtaggctgaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaacattattgaatttttatctaaatgtgatggaggatggacaggaagagaattactgattactctcagtcaggattcatcctagcagcaattatttgtaatttaactgaaataagtccatttgactgaagagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaattgttatacacccttcctcacagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattattttattttattttattttattttattttattttattttattttattttattttttgagatggagtcttgctctatcacccaggctggagtgcagtggcacaatctcaactcactgcaacctctgcctcccgtgtttaagcaattctcctgcctcagcctcctgagtagctgggactacagatgcatgccaccacactcagctaattttttgtatttctaatagagatgaggtttcgtcatgttggccaggctggtcttgaactcctggcctcaagtgatcctcctgcctcagcctcccaaagtgctaggattacaggcattagccaccgtgcccagcaattcttttggaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagactgccatgtaggaaacaggatgtctctaaagtgaaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacaaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtacaacatctgctactcctaccaaatgctaagccactatgaggatataatgctttatttttatttatttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgtttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacgtgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcgcagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaaatttttttcaaggaatagaaccactgcacatgctcctcctgatcccccaaagtgtaagattttcatgcaaatagctatctcccaggacttacattagtaaggtatctggatataaaaatcagtgttccctaaatcagctgtgtttccattatatcaaaaataaacttttagaaattaccatttgaattaacaaagatacacacacacacacacacacacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatcatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagaaatagacaaaagtgcccactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttcaggccatgatgggaagggggagctgaacatgcctcatcataccctcctcccttttggaattactggtagaacagactctaagtctgataaaaaaaaaaaaacatttacaatctattctctctgaagtctgctgcctggatacctggaggcttcatctgaatgacaaaaccttcgtctccacaaccccttatcacaagccagatattcctttctattgataataaggaattgccaatcagaaaatctttgaatctgcctatgacttggaagccacctcacccctgcctgctgcttccagttgtcctgcctttccaaactgaaccaatgtaccttttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcacatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcagtaccttttaaagatgttgttgctacattgtcttctcacttgcattatttccaacaagaaatctgatgttttctttgtgcctctgtgtgtagcatgtctttttatctccgatcacttttgagattttctctcactaactttcagtaatttgattattaaatctttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagatagattaacaagagaaaagcagataatcagggaaaaatgagtaactctcaaagaggtggcctagaattttggcttatgtagcatcttcaactaaaagaaagaaagaagggtgttgggaaagcaagctatgggaaagtgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactccgagagggttcttggatctcatgcaaggaagaagttggagtgagtccatagagtaaagtgaaagcaagtttatttaagaaagtaaagaaataaagaatgactactccataggcagaccagccccaagggttactggttggctatttttgtggttatttcttgattatatgctaaacaagggttggattattattcctttccaggaaagggggggtgcaattccaggaactgacagttcctcctctttttagaccatatagtgtaatttcctgatgttgccatagcacttgtaaactgtcatggtgctggtgggagtgtcttttaacatgctaatggttataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcatttttttttaaccctctgtttcattttggattgtttctattgctctgtctttgcattcattaatcttgttttctgtggtctaatgtgctctcaatcccatccagcatactggtattcatctctagaagttggcttttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacatgcacctgtgaaattaaaaaaaaaaagaagaagaaactttttatctgaggaatgtgagcccctttaaattatcaggctcggagaggcattggaatgaaactgcagtcacatcactcccccttgagtgattatcttgtaaagccacttgctatacgggctccagactaactgatgccaagcagccataaaataccatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtaggtgaggcaattgcagggctcatcttttttcttccctatctctcaggggtgactgtcttttgttgcctgatgtccacagtttcaaaaaacattgtttcatgtattttgttcttttgtttaattttgtttaattttgtttcaggtgagaggataaatccagtctctgctactccatcttggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatacactaagtgagggtctttcagaatagcgcttcagtgtctgcacctgactcacactattaggcagttaaaagctggggaatgagctcatgtgaagagtttttccatttcagatgatagctatttttaggaacacaagctacataaatgttttaacccttttcccatccttttcctcttgctgctgtgatacaggaagaaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacatattcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaactcctgggctcaagcaatccacacaccttggcctcccaaagtgttgggattacaggcatgagccactgcacccagcctatctcatcttttaaaaaaaacatatcaaataattgttcataaatcattttctgtagtagagagcaatttttcttaaaattggcaaataagattttgcatctacctttgagaaaattgtatttgtaaagtgattttaaaagaatgaagcctatgagtatgatggcattataaaagtatcagtggccaggcgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaagtattaatatatggaaatacaaatgtcatatatagatgtaaattctcctaattgttcttctgagcatcatgatttttttccatgaatttttattttaagttccagggtacatgcgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcatggggtgggcactgttatactccatcagtgagtacgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagtgatgaggataatgatcatagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgctcgtatagcaatcctcaaatctcagtagcatataaaggtaagcatttagttctcacttacaagtttgcagggcaggtgaggcagctctgcctcaagccacaatgtctaggacagctctgtttcgcactgtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacataccctcatgaggctgtggagagagtgtagattcagggagcggtgagaaactggggccagtacaccaacttacagcatgatttgtcatcatttttcattctctgctagtaagattgccaaagtctctctgcactcattgaattcatttagctctctttagctctctttttttagctctcatttagtttccatttagctctctttctctcttaccacaatacctaaaaatctttttatggggttacaactctgtctcaggagccacctcagtttggtggcacagagctccccacttgtactctgaaactcttttcttgaagatattgctatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagaaacttctggattcaaatgattgtttggaggcattagccaggcattgaaccaattataaagagtgaggttttgccatattctaaccgtaagaaacagaaacggtagagggtaaaaatagaatagaatgtcaatacaactttagccttttccctggattctgagagttcataacctgaaaatcagagattcaaactgggagagatgggctaacaggtatgagcatgggaaaagcatgtttcaagaatttgagatgtatttcccagaaaagcaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagaaggcaaaagaaaatattaataaatgaattattacgcacataatgttttgtatgtacatgtgtttacttttaatacaaaagtaacggactaagttaacatagatgttccaataagataatttatgtttcatttttggcttcaagtatcctcagggttataagtatcataagctgagaccagctgaattggtttgtgggttgatgaggccctatgcctgatttgaatttctcttgaatggtctgcagccctggaccaagttgaagaagccatgagagtctcagcttttttccttaccccattatgagataaactcattccttaaatatcttgctcatttgataaaacttggcacctttctcctttctactggtccctaatacttactacctgtactgtaagctcaaattttttgcaatttctgcctttattatgtaacgtattccactggaatatgtgttacaggaaaggggtcccgatccagacccctagagagggttcttggatatccagcaagaaggaattcagggccagtccataaagtgaaaacaagtttactaggaaagtagaggaataaaagaatggctactccatagagagaacagccctgagggctgctggttgcccatttttatggttatttcttgattatatgttaaacaggggtgggggggtggaccacgcctataatcccagctactccagaggctgagacaagatcatttgaaccccggaggcagaggttgcagtaagctgacatcgctccactgcactccagcctggaccacccagggataatccgtcccccgcaccccgcccccccaaaaaaatcactgccagtaaggaacaaacagccaggacgaagtactaagatgtaaagagatgtaaaatagcccgggcgcggtggctcacgcctgtaatcccagctctttgggaggcctaggcgggcagatcacgaggtcagaagatagagacgatcctggctaacacggtgaaaccccgtctccactgaaaatatttttttaaaaaaaattagccaggcgtggtggagggcgcctgtagtcccagctaatcgggaggctgaggcaggagaatggcattaacctgggaggcggagcttcaagtgaacccagatcgcgccacggcactccagcctgggtgacagtacgagactgtgcctccaaaaaaaaaaaaaaaaaaagaaagatgtaaaataatgtgatacattctgcaagagttatgacagagtcagaaaggggcaagcatgtttcttctctaccctgaagcagccaagggagaagaagatatctgttgccaacgctggggtgttacaagtgcacactgccatgcccggctaattttttggattttagtagagacaaggtttcactgtgttgcccaggctggtctcgaactcctgagctcaggcaatccacccgcctaggcctcacaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtgtaagtatgtccatttacagattgggagatggaggaatcacagagcggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgtgcgcctgtagtctgagctacttgggaggctgaggtgggaggatcgcttgagcctgggagattgaggctgcagtctgcagtgagttatgatcacaccactgcactccagcctgggcaacagagaccctgtcttaaaaacaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacgaggaaaattagagttatcaatgattttgggggatgagtggagtgtagttttcataggctcaaagcaaagcagggctgtgtgaaagggtaggcataggatgggactttgcagtggatccagggtcttgtttcctcagaaactacaacgttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggagaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttatttcccccccctttaatctatattttattttatttattttttacttttttgagacggactctcgctctgtccccagggtggagtgcagtggtgcgatctcagctcactgcaacctctgtctcctgggttcaagcgattctcctgcctcattctcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggtcttcccaagtgctgggattacaggcatgagacaccgcgcctggcctaatctatattttaaaaattgaactcttccatgtacccctgaacctaaaataaaagttaaaaacaaacaaacatacaaaacaacaacaacgacaaaaaaaaaaaaaaaaaaaaaaccaggccgggcatcgtggctcacgcttgtaatcccagcactttggaaggccgaggcgcgcagatcacgaggtcaggagttcgagaccagcttgactaacatggtgaaaccccgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaaaaaaaaagagagagaattctgtactttgtaattagaggggtaattcattaattcatgtcaggggcatattattttatttttccaaatgctaggaagcaggtatccattttttgataatataaattttgggataattggcagtcatctggctcacagggaaaacaggaaaaacaagaaacctaaataaacttcatattgatttcccaaaaaaattaccttttattttcaacccttatagaactcaacctgcatctctttgccatccatgttctttttttttagagactgggcctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttggacctatataagaatttcttttggataaaaactcaggaacagaagtgctgagaagccagaaaccagcagttctgttcagagttttatttacatctaattgaactaaggagtgtcaggctcccctccagaatgcttgtcccggacttccaataccaaggtagctggactctgagcccacatccaggcccagtcctcgggtcatccaactttctaagttttgccagactgcctggtgtaaagtggtatctcagcattgctttcgttttcattgttccgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattttttatttatttatttattatttttttgagacgaagtcttgctcttgtccccgaggctggagtgcaatggcacgatcttggctcactgcaaactccgcctcccgggttcaagtgattctcctgcctcagcctcctgagtagctgggattacaggtgcctgccaccatgcccgactactttttgtatttttagtagagacggggtttcaccatgttggccagactggtctcaaactcctgacctcaggggatccgcccccctcggcctcccgaagtgctgggattacaggcgtgagcgaccgcgccaggcctcaacctacatttcaagtcaccatctgtcacaggataccttccactctggctctggatatgggggtcacctcctcacaaagacagacaggctgtatgtgcatacacagaaagattcagaagaaacatgaagacttttaaaatcagtgagatgattttaactttctttaaatcagtgagatgattttaactttcttctttgtagttttctctagccagttttaaaaactgtaagttgtaggccgggcgcggtcactcacacctgtaatcccagcactttgggaggctgaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgaggcaggagaatcccttgaacccagaaggcagagcttgcagtgagctgagattgcgccactgcactccagcctgggcgatagagcgagactccatctcaaaaaaaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgttgttgagacggagtctcactctgtcgcccaggctggagtgcagtggcagatcttggctcactgcaagctccgcctcccgggttcacgccattctcctgcctcagcctcccgagtagctgggactacaggcgcccgccacccatgcctggctacttttttttaattttttttttttttttgtatttttagtagagacgggttttcaccgtgttaaccaggatggtctcgatctcctgacctcgtgatccgcccgcctcggcctcccaaaatgctgggattataggcgtgagccccagcgcccggccaatgtaaatgtatttcttactgtagacttgaggtcaggagagtgggctgtactggacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagccttttcttctttccagggttgttgtggactcaaacgagaggctgttagtgaaaggtttttgtgagttatgaagctcctaggaacccaattatttctgctgccttggccacatagtctagaagaatctctacataattagcatctagagactagataatttacccattattttccatgtgcttgtcttatttcccagcatgacggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgtccaaccattcaggcttttcattattataggaagcatctggccaaggaccaccaccatcttcctgtcctgcccctgaagctgtgagttccccaagtggagacacagcctgttccccaacacctacactcatgaacatgggagggttggtcaaaattgcacagctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaactaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctccctttttttttttttttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgccggctaatttttgtatttttagtagagacggggtttcaccatgttggttaggctggtctcaaactcctgacctcaagtgatccagccgcctcggcctcccaaattgccgggattacaggcatgagccgccgcgcctggccttgctttttctcttttaaaattactgttactcatggggtatctgcaggcctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattagggatgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtccacttgcaaagacgacagatctctctacaaattctgggctgagcaggtgaaggaggctggtcaggcccatgaaggagcctagtcagccgtaaggaaaggttcactgtggggcccccgactttccattcctgatctcctttttacctctgctgcccacttcctttcctctttccctccaagtataccttatactctgctcctgatgacactcagatctccccccgcccccccgcccccatcaaatataaagagcctagtgacttttgtaagaacggtgtattcatttcctagtgttgcattaataagttaccataaacttagtggtttaaaacaacacaaatttgccgggtgtggtggctcacgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactccgtctcaaaaaaaaaaaaaaaaaaacatgaaaccaaacaaaacgaaaaaaaccacacagatttattctcttaccattctggaggtcagaagcccaaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagattccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgagaagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcccagtctgtaaagtgagaatgataaaacatctgccttccttgcaggattgttgtggtgatgtgtaagacaaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatcagagtaataacaactggtggatgtgttctcctaggtagagaacaggaatctcaatttttaatgttgggagggactttatgcatctttttgctttcaaaagcaatttctggctgggcgtggtggctgatgcctgtaatcccagcactttgggaggccgaggtgggtgaataacttgaagtcaggagttcgagaccagcccagccaacacggtgaaaccccgtctctactaaaaatacaaaaaattagctgggtgtggtggcaggcgcctatgatcccagctacttgggaggctgaggcaggagaatcgcttgaacccgagaggcggaggttgcagtgagcagagatctcgccactgcactccagcctgggcaaccgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaattttttctttctttctttctttctttctttctttctttctttctttctttcttctttcttttttttttttttttttttgatacggagtcttgctctgttgcctaggctggagtgcagtggtgcgatctcagctcactgcaagcaccgcctcccgggttcacgccattctcctgcctcagcctcctgagtagctgggactacaggcacccgccaccacgtccggctaattttttgtatatgtagtagagacggggtttcaccgtgttagccaggatggtctcgatctcctgacctcgtgatctacccgcgttggcttcccaaagtgctgggattacaggtgtcagccaccacgcccggtcaatttttgtatttttagcagagaggaggtttcactgtgttggccaggctggtctcgaactcctgacttcatgtgatcggcccaccttggcctcacaaagtgctgagattacaggcatgagccatcacgccccgccctaaaacaccaaatcttattaaatctatattctacaactctgtcacatccatcacttcatctctgcccactcctagcactgacttagctgaggacatcatcaattctgatcaaaggaccctaagtctaagtaacaataccactttcatggtaggctttccccggaaccagctggacataatgagaattttcaagagaatgtgaattgctctttacttgattttctttttttttgagatggagtatcgcttttgtcgcccaggctggagtgcaatggtgcgatgtcagctcactgcaacctccacctcccgggttcaagcgattctcctgtcagcttagcctcctgggtaggtgggattacaggcgcccgccaccaagcccggctaatttttttttttttttttttgtatttttagtagagatggggtttcaccatgttggtcaggctggtctggaactcctgacctcaggtgatccgtccgcctcggcctcccaaagtgccgggatttcaggcacgagccaccgttcccggcgattttcttttctttaagactaatctgaaagtgcggaactctgtgtacctgaaatgattacattttgatattgacatgaaaaaattgggtactactttgccccagtttctcaacccaacaaagacattccaaaagtttcctatggggcctaggaaggttggccttcacaggatagtggcaggagtgttaactttgtcctattaccaaaaggtgtcaaagctgttactaaattgtctgtgtcagtatcggaaaccccgacagcactggagaattcctcatggtccttccagaccatggtcacagtgagaagcagattctgttgccctggccctgtggggaaatccccaagatggctgctgatagttaaggaaacagtgtcctgccatggcctgaccctaggctgggtgagagagagtgggtcagacaggctgcacttcctcagtgagtgtgcatacacctgttcgcactgcctatcgtttcctcacccagtgtgagagcagggggctcagttgggctgagtggagaattcatgggacctttccatggtcaaggcccagagcttctattgtgtagcatccctggaacagagaacaggaggcagtcacaaggccccagcttcaacctttgacagtacaccagaaaagaccaagtagtgaggcctccactgtctcacaccagccaagaaagaccaggtcttagactatccagtgttcctgcctctctttcacggtgctgtatctggggaatgaatactccattgtcataggaggggcagatgcgggcggaagactcagaagggtcaaggtaggacatagacattcccactaagctagagacccctgaactgccatagccatgacatgcacacgttgtcctcaaatcccagggccatgggcaggtcttggatatctttggaattttaagttggttggcatctgtctagttttaaacctgatttaggttcagttcaaccagggagtatgattctttggggagagggccctgacctagaaatctacatgctcagcggtctgctcagccactaatggctctgacacactggaaaggcactcaccctctgggagtttcagactgtatctttgaaaacaaaattcagtggatggggtgcaaaggtattgtcctcaacagctctaagttactacttctaactcacagagcacatatcacaaaggatcccactatccattgtcggtctgagcagggaatgagactttggcagaccatgaatcctgtattaatttctagggggactataacaaaataccacagacttgggggtttaaactgagattgcaccactgcactccagcctgggtgacagagtaagaccctgagtcaaacaaaaaaaaaaaaagtgtatacatgggagcactctgtgatgagtaactcaaaggagtggttagaatttgggatctacctagcagcaggggaaaaggaggaggagtaaaggacatatggaaaaccaaatgacttttgaaaagataaatgggcccttagaatagatggaagattcgagtcttgtgacaatgtctatttgggtgtggtgaccacttctcatctccgaggttagatttgcttctagtgctgaagaagatttatgacaactgagttaaaaatttgagatttgcgaggaggatctgctattaaacaggtaagggattttagctgtttgtttcagctgaaaataattcttaagtcgaaactggcacatttggaggtagcatgtcctgatccccttaaaaagggaactgcacagacaccgtatctctgattctgcccagggtcctgtgccctctgacaccagaaatcaccacttctctcagccttgttttgcggttgttttatcatgttgcaatttggttatgtcttttctaatagtgtttaaaagcaatcaaaggcaggaacttttccttttataaactattgttgagcttatattggacactgaactaagtgtcagtttacaaaaatgaataaacaaaaatcactgccagtagggaacacacagccaagatgggggagtagtaagatgtaaagagatgtaaaataatgtgatagattcggccagagttactaaagagtcagaaaagggcaagcatgtttcttccctgtcctgaagcagccaagggagaggaagatatctgttgccaatgctggggtgttggtttaggcatgtagatgctgtgatgcgcagtggaaccgttcaatgagcagacaggagaaccagctttatgcggggagggagagaattgctcccctcatcccccgtgagtcacaccctggagattataagtttaaacattttgatttcgggagattttgagttttgggcttaaaatgactgaagaaccaccaggtggatctacgtgtctcgagtccagaagtctgaatacagatttacgatttatgagcacacagaaggtggatccaagggagagattaaacagggcacagaagagtttttaaaaataatatttttcgggaaaaaaaccccaacaaaacacgattctttcagcagaaaccagaagattttctcatagactctcctacagagagccctgataaagtaataaacatgctaacagtaagaaccccaaccaatttcatagggcagtttgcggtaactactcccagtatggagcagacagtcctcttgcaaaacccgatttagcaaactttgctagctccatgtggggcctccaaaggacacagctgggcactaaatcctggctgaaaacaaaggccgatttagaggatccgtagaaacggatgcacagaatatccctcagtcttctctatgtagcaggccctccatatacgcgggttccccaagaccgaaaatattaaacaaatgaatttcttttttaaaaaaaagtacaacaaaagatagtaaaaataaaaacagtataacaattacttacatagcatttacactggattaggtgttacgaagtaatttagagactatttaaagtacacgggaggatgtgcatagttatgtgcaaatactacgccactttctatgagagacttgagcaacctggattttggtatcggcgggggccctggaccaatcccctctcagttctaccgagggagaactgttttgtttcttccagcacggctttgaccgacagtgtgttgggattcgctgacgtccatgagaaagcttggcagcatgctgagaccaattttcccagggccagaattctcctgtgtgagctaaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttcc

SEQ ID NO: 267 - DNA, 774295 bp, Homo sapiens
  misc_feature (412280)..(462279): n is a, c, g, or t
acttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcatcattcttgtacacttctcattggccactggtgtatttctatagggtggaggcctggagagcagttgttccagcatagtgtttacatagcttttatttaattccgttttctttcctttgttgctttattagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttgatcgccaacgtagatcggaactcggttcaccagcgacctgaggacccggcccagaagagggagtgtctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtacgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaatggtacctggttttggccatgctttgagcctttattcattctgttaacttgagacggtatataagcctctgcatcccattgtgtgtttcactcacgtccatgtgaagagaccaccaaacaggctttgtttgagcaacaaggctgtttatttcacctgggtgcaggcgggctgagtctgaaaagagtcagggaagggaaataggggtggggccattttataggatttaggtagataaaggaaaattacagtcaaagggggctcttctatggcgggcagggatgggttcacaaggtgctcagtgggggagctttctgagccaggatgagccaggagaaggaatttcacaaggcaatgtcatcagttaaggcaaggaccagccattttcacttcttttgttgtggaatgtcatcagaacaggccatttaaatttcacttcttttgtgattcttcagttatttcaggccatcttgatgtctacttgcaggtcacaggggatataatggcttagcttggtctcagaggcttgacattcctgtcttcttatattaataagaaaaataaaacaaaatagtgttgaagtgttggggcgatgaaaatttttggggatggtatggagtgataatggacgatgtttctcagggccactttgagcgggattaggggaggtgtgggaacctagagcgggagaggttaagctgaaggaagattttgtggtaaggggtgatattgtggggttgttagaaggagtatttgtcatatagaattattggtgatggcctggatacggttttgtatgaattgaaaaaagaacggaataagacaaggagaaaaacaggtattaaaggactaagaattgggaggacccaggacatccaattagagagtgcccaagggggttcagcatagccctgccatcaaagattatttatttactttaagagggagttaagagtggcaaatctggggacagcaccaggagatataagctgtgatggcttggagaaacagagtaaaccgccagtttaaacaagagcagagcatttatgagtagttgagaacggtgaatagaagtatgactagacagaagatagtagtgatgacaagtttttgggggcacagtccaagttggtctggtgtctggaatgagactggggcctaataaaaaggaacatctatacaggagcttaaatgggctgtaccctgtagcattctgaggacaggcccgaattctgagaaggcaagtggtaaaagtattgtccagtcctttttaagttggtggctgagcttggtgaggtgtgtttttaaaagaccattagtccgttttacctttcctaaagattgaggaccgtaagggatatgaaggtttcactgaataccaagagcctgagaaactgctcgggtgatttgactaataaaggccggtccgctatcgcactgtatagaggtgggaaggctaaactgatgaatgatgtctgacaaaagggaagaaatgaccgtggtggccttctctgaccctgtgggaaaagcctttacccatccagtgaaagtgtctacccagaccaagaggtattttagtttcctgtctcgaggcatatgagtaaagtcaatttgccagtcctgggcgggggcaaatcccctagcttgatgtgtaggaaagggaggggcctgagcaatccctgaggggtagtagaatagcagatggaacactgagaagtgtttccttgaggatagatttccacgatggaaaggaaatgagaggttctaagaaacgggctagcagcttgtaacttactgtaggaacacaagatgactgctttgggggtagtgttgggtagctgctattgtgctaagggctgaaattgactgaaattacctacaatttaccaactgggccttcctccagaagttgcaagccatcagtaggctccagagctctgaaatatttacatcagacagatcctgcctgtgcagttgttgtctagattccaggtgcttctcattccaccatcttcccaggatacactctgagcttctggattttgaattcagtcaagctgttctgtaacagctggggtgaaagccagcaatgatcctgctaagaaagctccctggaaaaaaaaagttcaaaagtaacataaatatcaaactggaaagaaattgatttaggaaccaaacccaggttgtcatggtgaaaaaaggggcagaaccttagctactgaactgcagcctggggtacgaggtgacaaccattgcttttttagtttggtttggctagcaaaggtggccttgttatataaataaagcccctctggtagtcaaaacctttattttctctctctctcttttttttttttttttttttttttgagaaggagtcttgctctgctgtccaggctggaatgcagtggtgtgatcagggctcactgcaagctccacctcctgggttcacaccattcttctgcctcagcctcctgagtaaatgggactacaggtgccagccaccatgcccagctaatttttttgtatttttagtacagatgtatttttagtagagtttcactgtgtttgtcaagatggtctcaatttcgtgacatcatgatccgcctgccttggcctcccaaagtgctgggattacaggcgtgagccaccgtgcccaatgaaaacctttattttcgtgatggctgcttatttatttatttatttatttatttatttatttatttatttattaatttttctttccctgctctccctctttttaaatttttattatttatttatttatttttctgcagagatttatccaattcagaggtcttgtccccataatttggaacattcctttggatttgatcaagtcagatagaactggtcaaacccaatggggaaaagaaggaaacaacaataaaaacaaacagaaaacaaaaaacagttcagaaaattaatgatcgcacaatttatatgattgcttagcactctaacggtaagaagaaattatgatcagttggttgttaatcttttttatttttttattttttattttttttgagacagagtctcgctctgtcgcccaggctggagtgcagtggcgcgatctcggctcactgcaagctccacctcccgggttcacgccattctcttgcctcagactggttgttaatcataactttaatcatttaggagaatttcaagacaaaacacaggttcagttacttacctaggaatagggcccaggctgaagactgctctgtaccatcctagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaaccttagatctcgatcaaattttgggaaatcagggattctctggagggggtggatctctgaggcctcagcaaattttcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaagtatagcagccaggtgcaaattgtgggggcctggaaataattttggtataacacagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccactcgctgtttagccctgatttgcatatgagactttgtgctagtcatctggtaacttttcactcagcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactttgaggtgggtgaagattagagcctggattaatcaagggcctgtggcttctaacaccatcagttgcctgtactcagccaccttcagcagtgctatctggctctagagagccatagcattccaggaaaggaaagaagtctgcacaaagccctgatgtttgtgtccccccatctagacagacatagtagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcatcaatgaagagtttcttcctcattgaatcactaacacgttttggatctctctgacttcctagtttgctgacctctgacctctagatccagactttaaaggcccatgttattagattagtcaacctttataatctccccattttaaggttaattgtatctgcaaaatccctttgccatacaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgtattatctgagttcctttctcaggaaaccaagcgttgggccctccagatagtatcaaagaactgaaatttaccagagtaccacatctggacaatgaaatgtcagaccccttatcccatcaaaattgcctaagtgaccacctgcttcctgttgaccaattcctctttcttacctctccctaattcctgttttcctgtatgtagttccatttcttccctgctatctaaaccctgaattttcattggtcaggaagatggatttgagactgatctcccatctcctaagttgtagtacctgatgaaagccttctttcctagcaaagctagttgactcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagagtacaattataaatacacatgcatctaatagagcctcaaaacacaggaagcaaaaagtgacagaattgaagggagaaatagacaatttaacaatagtagatggagactttaataccacaactttcaatagtggatacagcaactacacagaagatcaataaagaaataaaagatttaaacaacataacctaccagacatctatagaatactccactcaacaaaaacagaatacacttcctctcaagtacacacaggatgttctatagaatagaccatatgctagcctttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccacagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctataattccaatgttttgggaggccaaagtgtgagaataacttgggcccaggagtttgagacccacctgggcaacatagtgagaccccatctacacaaacacacacacaaaaaaacacacacacacacacaatagctgagtgtgatgacatgtgcctacagtcccggctattcaggaggctgaggcaggaggatcacttaagcctcggagtttgaggctgcagtgagctgtgatcatgtcattgcactccaggttgagcagcagagctagaccctttctattaaaaaaaagcaaaaaaaaaaccaaaaaactaacatgcttccccagtgggggaaatatgtcagtataacattggtttgcagcaagaagtatattaagatattgaccaaaatccttttattatttattttgtttttattttttgagacagggtctcactttgtcatccagaatggagtgccgtggcatgatcttggttcactacagcaaaaaacacctggacccaagcttgcagtgagcaatcatgtctcactgcaagctctgcctcctgggttcacaccattatcctgcctcagcctcccaagtagctgagactacaggcacctgccaccacacccggctaatgttttgtatttttagtagagacgaggtttcaccgtgttagccaggatggtctcgatctcctgacctcatgatctgcctgccttagcctcccaaagtgctgggattacaggcatgagccaccgtgcctagccccatgcctggctaattttttaaatttttttgtagaggcagggtttcgtcgtgctgcccaggttggtctcaaactcctgagctcaagtgatccaacaaccctggtctcccaaagtggtgggattacaggtgtgaaccactgcacctggcctctaaatcgatataagtcaattattcacacactgagaggaatattcaggatttttttcttataatataaatgatgtggaaatctggagaaccaaagaagaacaccaagactatctaaaagtgttaaatttttcattaggaagaaaatgaattcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgctgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttagatacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacatactataaaatttacccattataattgtacagttgaataatttttagtaatttacccaagtagtgcaaccattaccataatccatgcatttgtttttaatttattatttgtctgggttctgattctacttccaccacaagcttcagcatggcagtatctgccaccacttgttttggtccaagggcagaaatgagcatcctggaaaccaatcagtacttgcgctctgaactggaaaagtgcaaacagaacttccaagacctcacagagaaattcctgacatccaaagctactgcctactgcctggccaatcacctgcagaaatgtagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggtgagtgtagtgaggaatagagactaaaaccttggtttaggcatgaaactgtctttcccctctcagcaatgaatatcagattccacaaacatgtaacatcactgttggttaaaacatctcaggattcgatttaaacttttttaagagcgcccatttgcaaagcactgtgccaacagcatcaggggtgatagaagtaatagtataccctatctgccttgaaggaacttaaaactagctattctcaactgagtcacagatatgtggagatgtgaacttcaatagcagacatggaaaaaagtctttatgatacctggatcaagattctcttcccacaaaagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacctgttactaatagtcagggaagggaagctgtaatgacaaggaaacatgggaacaagggcatgagaggaacagggatattagaagaggattctggttaacatagaaattgagtttgttttccaatttctacaattattttaaaatacatcattgtgtggggggtggctaaaagttgctgtctaacttactgtcatagaaaagtaaaaccaaaagcccacttattaaagaagtgaaaagatgagctttggtgtgtggaaaaactagtttaaaaaaaaaaccttcactcattataattgtaggaaaaaaatttctcaagctagagaagaagaaagatattacctaagaccctagtataaaggtattattgtgcagtgattaaaaagcatataccctggggccaaatttcctgggttcaaatctaacttatcatcactgtgcctcagttttctcatctgtaatggtaatagagtaggaactacctctttggatggtggtgatgatcatatgatgataattcttaaaaacctactgcaacagtaccatgacaaacactatgtgttggttctccctttaaaacaccacctattagcttttgggcacatatcatttggatctttctcctctatatacagttttacacagctgtatacagataaatgtttaaatctttgaaatattttgggattattgaaactcctgacacaggaggaccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtatggtggggcacacttgtaatctcagctacttgggaggctgaggcaggagaataacccgggagtcagaggtgcagtgagccgagattgtgccactgccctccagcctgggcaaaaaagtgagattccatctcaaaaaaaaaaaaaaaaagaaaagaaaaacatgtggcgtcagacctcaggggatgtgaattctgactgcctcattccagctgaatcatcttgtcaagtgactttatcaggcttttctttcctcatctctaaaacagggagtagttgagagactgaggaatacagatatggaaatcccagcgtaaagcctcgtactggggatacttttatccttgagatagaccctgcctcctgccctgcaggcagtgaccacagcagcatggccagccttccatgatgcaggcatgtctatcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagtagggcagctcaggctggtagaacaaagagcaaatttgtgcaaggagaagggcagaaatgtatgactcaggcacagaactagactaagacacaatgaggttatggtctagttaggtctctagggttttccattaaatagcatattagtaaaatggagacagctgtctgcattggaatactagcaatgtggcttctatttgtgtgtccttggtcaaatttacttcacttttctgcgtgtcattaaactaggctacctcatttataaaatgcaaatactgacagtatctacttagagggttatgaagattaaatgcacaattgcaagtagttagaaccatctctaacacatataaaactctgaacaactattttctgtaattattatatttgtccccatttatagatgtggtgattgtcattaatattttctataagagatattttcaaactttccaaagtgcctttcatgataacaatgtttctcctccaaactttttaaaaaagtattatactaggtggagtattaactggtagggctgttgggtagatagatgattgagcagctgttgtgtggaaaatgaattattaattcgctcaggaccagcattgactatccttagagggtttcagacataaggtagattgtcgcattcgaaacttcttttaatcctttgttgaaatgaaatcatagaagctcaaatttgtaaaactcaccaaagcagagatatttgattgaaggtgggataggtctggagcccctgtttctccccagtatgtgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgggtacatactaccgggtgctgtaagttgggtaataggtagcactatctttagactcacagagctcacactctacattggaacccatgtgtattagtccactctgacactgctataaacatatatctgagattggtgatttataaagaaaagaggtttaattggctcatggttctgtgggctgtacaggcttctgcttctgggcaggcctcagaaaacttacaatcattgcagaagtcaaaggggaagaaggcatggtcttcacatggccagagcaggagagagagagagagcaaagagggaggtgcacactttcaaacgaccagacctcatgagaactcactcactatcatgagaacagcaagggggaaatccaccaccatgatccagtcactatccagcaggtccctggttggattacaatccgacatgagatttgagtggggacacagagccaaaccatatcaccatgagaaatatttaaacaataattagaaaaaaaataaatccgcacagagtaatgaaattactactcagaactttactttttttctttttttgagatggagtcttaccctgttgcccaggctagagtgcagtggtgtgatctcagctcactgcaacctcaacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcatgagccactgtgcccggccagaactttagttttaactgccttcttactgattatagtctatcttcatgtcattcagaagaatactgcccctcttgaccttttcactgatttttctttttaactttcaattaatactagagataccggcccaacagttttgaacttggcttttttttttttttttctgccagttactgcatatgaaaaggtacatgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacactgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggagtcagaggcggaggttgcagtgaaccgagatcacatcactgcactccagcttgggcaacagagtgagaccctgtctcaaaaaaaaagaaaaaaagaattcaacttgggagttccttacagggattctaagagatctctcctctgaaacttctataacctattattcactacattccctcatacattttactcttctttcccaccttaggatacatgatcccttaattcaggctcaggctgaagaactgacccacttacaacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgccccaaagtggggagaaaaaatgcaaacttatctccattatagattttattttagttttgactatggtccttaatctgcattctattgttttctctttagagcactcaggtaatcacttttcatattctttctagaattctaagttttgttttttattttgagacagagtcttgctctcttacccaagctggagtgcagtgacatgatcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggctggtcttgaactactgagctgaagtaatccacctgctttggcctcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccactgtcttctggcttacactgttccaacaagaagtctgccataattcttatttctgtttctctgtacataatatgtcttttttctctggatgcttttgagattttctatttatcactcgtttgaagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaatttaatttatgtctttttttaagttcttctatgtaactcttcatcatttcatattttcctctagcttctttattttattttattctattttttgagacagagtctcgctctgttgcccaggctgaagtgcagtggtgagattttggctcactgcaacattcacctcctaagttcaagtgattcctgtgcctcagcctcctgagtagctggaattaccggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctctccaagctggctttttaatttttttcaggcagcataagagcagctattagtcaactgctattttttttcccactatggaggcaaaatgacctttaagaaaatagaccttattttttagagtagtttcagattcacagcaaaattgagcaggaagtacagaaagttcccatataccccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcacgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccgatgctaatctaatgccatcgttgatctgacaggaggctgagctcaggcggtaatgctttctcgctggctgctcacctcctgctgtgcggtcccattcctaacaggccatggaccagtgctgggggttggggactcctgttctaaccaatgctccctctattaaaagggattttcacactagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgtcttcttcaaagttactaccaggctctgcctgggtcctccctccctgctctacagttgacaatctcaggcagcaaactggagcaatcatagggctcacctcttttatttattatagtactgcactgtatccaatgttgaagatagagtttaaaatactttttccagtttctcagttgtttaaggtggaggacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaagaattacccccaacaacatctgaggaagcacaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcagccaggcaagtattctttgagctggggaacaaaaggcatttaaaactttttgctctgcttcaggcagctgacgtctggtgatgattcaccatatcaggaacaccctgtccagtgggctaaggcaagcctgccaggccacttctctaaagacacaacctgaggcctcctgcaataattctcacagagcattctgaacatacatgtaagctgttatgtccctgatcatatagggcccatgtgtgcaatgtgtgaaatgggacctgcttaatttctgactagctctttctaattttggtttgcagaaaatcacaatggtaagaaaaatgaagacaggcaaaagccactggctcccaggtaactctacatgatgaaggggctgataatggactgaccaaatctagagagaattccagaagcaaggactcaagaggttgaaggtcccagatctagaaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcattttacaaggtcaggagttcaagaccagcttggccaacataatgaaacctcatctttactaaaaatacacacacacaaaaaaaaaattagccaagcatggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaggttacgtttcatttccatatcattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatggtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttacagtctattggatattatggtgaagggcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttgaatcaacttcattcatcatggaagaatgttccattcataaacagattaaagagtaccttagatccatagaaggtgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgatcatgcgcttactctgagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcatatgcaaaagggctatgagtaggaggaaaactcaggcctctgaggtctcctgaaagagttttgctaatgtcacaactggctttctatgttatctgaagattgagatctccatgaagagtgaagataggtaatgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatacttgcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcatctagaggggtcttactggaagccttttactcagtccctttaatttccttgggtgtatactacggttccactgacatggatgacctggtagtagcgcagcagcctgaaataccagggtttccttagctgtggccttagctgctctttccaaaagggaatttcctctaataagaacagtgtcttccttctggtgtcccctgcagtgaatacttgttatttctttgggaattggacggcatctaaaagttccaagatctgagtaaagttgtatgggggatcccttggctcttgatagtcccctttccttccctatggttgcatgagcctgaagcacccggaaaccatacttagagtcagtaaacacattgactcttgagggtttttttttcttttttgaaacggagtcttcctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgtaataatccatacttcattatcaggggatggatgccccttggagccaaaggtctaaaaggatactggatttttctttttttttttttttttgagtcagagtcttgctctgttatccaggctggagtgcggcggcgcaaggctcactgctacctctgccttccgggttcaagcaattctcctgccacagccttctgagtagttgggattgcagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatattttttttcccatagataattaacactgggtttcaaaataacctggactgggagaacatttgcagttcttccaggaactaccatgtcacaagcagacgggtctacttgagaagtaatatttgatggaaggaacgtcttttctttatctgtgttaagacatgaacttagagctaggagaagtgtcccttcccagcctgtggccttctcttgaggtgctccaaattgaactgcagcctgttattgggaaagtaagtctcttcccagtaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggccccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccgagaagctcagactccgtttggagactgaggcagtctttcctccagtggccctcttgcttacagaaggcacactgattccagcctaggggatgatgagctggcttttgtctgggcatcccaaagccactcttgcaacactttctcaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagagcccgcccttccgggttgtctgggtctacattagtatatttcctgagtgcctcaaccaagcagccctaaaacagaatgggattttcatccttccactgagttacttctctatccttgtcacaattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatacttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtgggggatacaggctggagctagctaaataaaagggagggttttctgatgacattggggtgaaatcccacactggagaactggcaggacccctcgcagaactgggggactgagaagaccctggagagggcatgggccctccagggggtgccgctaggaagggagcatcgaggatatcccacgcggtttcttggtgcctggaagtaacatgagccagacacatcctgcagttgactcttaagtcagaatcctggtagggggccatagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagaagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaaatatttgggcaaaatgtttgggtggctgctgcttgtctgccactatgggtagttgtcacttgggccaggggtccaggaacccctggtccctgtgaccaagagttcaatatgggcttgagcaaagtcacgtaggagggggcccacaactggctgttatggaaaattgtaatcttttaatttaagggcggagaagatgacatccacactcctccagggaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcactaccaagtgtcctgccttaaacagttcttgactctgtcctgtcctgtcctgtgttatatcatgtcctgtcccatcttgttttgtctttgtggtcaccagatgatgcaaggaaggacaaccccaaaattggggcttagcccaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggttattcagaactttttggaaaagggatgaggagtttccagaagcatataaggtaacttcctggccattgccatggcaagttgacatggcatttataaactgtcatggcactggtaggagtgtctttatgctaatgagcagtgagggcaactagaggtagcttttgtctccatctgctggttttggtcagcttctttactgcaccctgtttggaccagatcctgctctgatcaactgggccacaaccgcaaaataagtcctgccactttcctgcctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacatatcattagctggaagctgcctctatccatatattaaaggtttctccatatgtagtgaactgtaacctaactggatgtgtaaacaacctgtaacctactcttgagccaatgactgaggtttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtattatatattatatacacatgtaatatatatatgtatgtgtatatataatatttatttgagagagagagaagtgacttgtggtactgatgttgcttgcctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcatgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccaggaccatcaaaagcacacctgcactaggtcattgggaactttggaggtgccttacatctgggcatgcattgaaccaccacacaaggtgaaatgcctcttctcaaagaggcttgcctgcagtttccactaacgaaattgtgagtcatagctgttcttctgtttgagatattaggagggattttgtggggggtgaggggggatgaaagtgagtttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaagtggaaagattgactgagcccagcaatttgagaccagcctgggcaacatggcaagatccccatccctataaaaatttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagcgtttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcacgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaacaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggacaccccactggccaacgggaccctaggcaaaccttataaactgagtcccaggccaagaaggaacgggaggccagacaagcctcattatattcccacccttttgcaatttagacaaaactgaccaacattaatgttatcacagagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaagtttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcattatctgtgggagagttactctgaaagcagcaagaagccattaccagatgcagatctcattctgtcagtaatggcaacccagcaaataggacaggagccccacccaggttggatcaatgcatggctgtataaccttgagcaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcaccattaactccccttcttcaccagagttttctggcacccaagactacagaaactctcctgcagtgggctttggggcacatcgcaagttccagtaacaagggctaagatcgcccgcttttggagaccttacaaagcatgtattccctgaccaggaatcgaactcgagctgcaggcggtgaaagcgccgaatcctagccactagaccaccagggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttaaactctctattgaaaaatgaacaaatgttcagaacagaggaagtagagtggtggcaccatcaaaggcaggaagggccaagagaacctgatgggagtggggatatagacctggttctagcttccagtcttccagtcactaactttctgctgtgtgcagggcacaatggaagtaaacaccacccactatatatcccctgtgcctggcatacagaatcattcatacatgttgaccgaagggtttcctttgcttctaggggattatgtatcattttgggaggaagcatgtattctgtgaggttgtttagtttatgtccaagtgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtactctttatcatatgaggagagtgctaattaatgtgtcatttattttgtgagcatgctaataaatatattcatattccaatttagtgaaaaaaaattgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttctatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagctgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctctctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccatgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatatgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgattttttgctgtgagacaaacttgaaaagttcacagacactgcctttctctgaaaactgcccttacctctttgttacaattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcctgtgtccttcagtggtgatggctctgaaacccttgtgttttatgaacttcatgccctggtcttcaaacgaattcagtgcaggccaagaagcacagtttggcctgggttggatgctctatattttcaaacagtgaaatgccttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcaggtcaggcccttcagcctggtggaagagcaggcagggagggtcctatggttcctgggaggacccgaagcatgatcacctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgtggaaccgtaaatgagggttcagcctgtctgcctgagggattgtgtttcctggcgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacacgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaatcccaagaggtagatgttgcggtgagctgagattgtgccattgcactccagcctaggcaacaagagtgagactacgtcttaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagaagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaatatatatatatatatatatatatatatatatatatatatatataaaaattagctggacgtggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaccgcactgaggggaaaagtcaatgtgaaattctacaaaagctgaaaattcactaccaccagccattaccacaaaaaaaaaaaaaaaaaagttgaaggagtcctccaggcagaacgaaactgacatcggatgaaaatctggttgtccaaaaaaaaaaaaaaaaaaaaaaaaaaaactagacatgacatctaatagaagaatatataattttaacatctgactgtttagctgggcgtggtggctcacgcctgtaatcccagcactttgggaagctgaggcaggcagatcacttgaggtcaggtgtttgagaccagcttggccaatatggtgaacccctctctctactaaaaatacaaaaattagtaaggtgtggtggcccacgcctgtaatctctgctactcaggagtctgagtcaggagaatcgcttgaacccgggaagcagaggttgcagtgagccaagattgttccactgcactccagcctatatggaacctagtttgatctggagggatcttattttataggaggcttggagggggaccttttgctttgtgtactcataggatgcacaagacacaagggaacaatctctcactttttaaatacagtgataggcctgaggagaaacaactgcaaattttttttttttttaatgagatgggattctcactggtcttgaactgagctcaggcgaggcttcccctacgtcggcctctcaaagtgttgggattaataggcgcgagccaccgcgcctgaccacaactaaccaacatttaaaagcacgtccctgggtaggctcgaaccaccaactttccggttaacggccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttccacgttagaaacgcttgcattgcctgactctgaaaccagaagggcggccgaatggccttcaccctccgttaaccctcgcctgcttcagaagccagtgcctctggaaatgcctggatctgcgaccccagcctgagcctagtagggcccaagggaagctgaacgccccgacggctctcatggtagctctttctgtttttttgcgccgccttcaggcaatcatctactccgcttgctatcccctcactcaactcggcttcagtagatggggttggtggggcgggagcgggaaagaagcaggggagtcaaaagggaaaacctgaaaagaaggagggagaagcaggggagaccaggacaagacaatgggacagcccaggatgccggtgcagagggcaccggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggggaccgggagcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgtgtcttttggtttgcctttaattcctgcaccagctgcggcctttatctgcagccagaaagcaggttttaccgctggtcccacagcgccatacggtctggggaaaagaaggaaacccaatagtacacaaacaaaggccaaaagagaaaccttccaagtgctctatgccttacggtttagcagaaaatatcaaacaactctcaacctagctggtctgtagcttccacaaatgaaatactgtattcattgcagcctttctggttgagatatttcaaatatttggtggagcttttaatgagacggagagacactctcgagtgtggaagaaaaaaatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctacagggacagcacagcgtcctcgccctggccggacgctcagggtcaccaccctacccactgcccccctcgccattcttccaaaccactctctgccaaagattccaccgacagtcaccccacacgacaacccaggccgcctttcagcagcggctcccgccccgcaaccacgcgccctctcacccccgcggttctgcccgccgcctctatccagtctgtgcacttcacctccctggctcccgctctcccctgagcttacagtggacgcggggttcttccgaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacagctcagcccgataggcacctccggggcggcgacggcaaagagggtgcccttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctagctgcggaggctgttctacatctgacccttggagcaggccggctgacagcgtagtaaaggaagatttctgcgggagggcggccagtgcaaaacaattccctgaccgggaatcgaacccgggccgtgacgctttcagcaccgaatcctagccactagacaaccatgcagatgcggaaagctgctttctctcccttcttcgacctgaagcgacactttcctgtgctctaggaggacttgggtcttgtgagagtcgctctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgcgaggcggcagcaactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcaccaattcgtgatttccgtcggccaagtgcgtgggcattgatctacacgtgagtttctccacctctgccgaatggctacttcggggtgggggaagggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttttcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcagatgcgcggtgcgcggggaagaagaggatttgactgcggttctccacccccggcgcctaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatgtaaactgggtggctaattcacaacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaatgggactaaatccagactcagttattgcaatgtgtgcaaaagaacaaggacttgtactatctgacttcaaggcttactataagctattatagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctccgttcttctgtggttagaagacctgaacccaactccctccccaagcactggagatggggcttttccaagggctagggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagttttttttttcttcttcctttttttctctagctaaacaagcactggccttgagataagcaatgctgaagcacttgcagctcacctattaccaaaaactgactgagccctccctacacaagccataactactgctttgattggacaagagactgatttcagtagttttctcttggtaagagaccactggccgtgggctggttctggacagtttacagaagctatgcacttgattgcctttgtgtccctgcttcaccttttgaagcatagggcctaattataatgtatttaaatgttgtctccaccccaaagtgaacatgggttgcatgtaacaggcgtgtttactcagcatgcatgcagcaggatcccttcacaaatattcagagctccccctattccctgttgaatatgtatatgtggccaaccagatcaacgtaaatcactattcgccctcccctccctggaaacttacttttcgggtttcagcaggaagctatgcctcccagtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcaaataggcctttgcaaaggagaatttcttatatgctggaagccataaaaaaatatgcttcatagtattgctcattaggcaagtacaaattaattccacactgagataccactaaccaatcaccagtgtgtggctacttttttttttttttctgagacagggtctctctcacccaagctggagtgcaatggtgcgattggtgcgatcttgagtcactgcaacctccccctcctgagtagctgggactacaggtgcatgccaccatgcctggctaatttttgtattttcagtagagacggggtttcgccatgttggccagtttggtctgagagcatagctacattttaaaaagttagcacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccagtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtggactaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctacaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcctggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccctccgggagcttcatttcttgttcctctccgtagtggctcagcggtaagcccaaggtccagcacacgaatcaggaaactgatggttcttgggttagcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatatcttttgctgctactttggtcagcgttgttgtcagtttaccttgtggtggccaagcccttaaatgcactattaggttatgcagtgtaattctgcagggcagaagggtaaagagccatagtgaagagcaaaaatacctcttatcttgaccgggaattaaacccgggtctcccgcgtgggaggcgagaattctaccactgaaccaccagtgcctctctctagcaaccctgggagaattatcaaaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcagtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagtagagagatttcttttctcaattttccctggagagattaaactgaagagaaaaattcagagagtttgccccacatgttgggtctgcgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctatatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaatagcgtttaagtttattggatactccacaagcttactgccactttattaccacacttttccatctatcggctcttgcatccattaacataagcagacaaaaaactggactcctggccgggtgcggtggctcaagcctgtaaccccagcactttgggaggccaaggcaggcggatcacgaagtcagaagattgagaccatcctgactaacatggtgaaaccccatctctactaaaactacaaaaaaaaaaaaaaaaattagccaggcgtggtggcacccatctgtagtcccagctactcgggaggctgaagcaggagaatcgcttgaacccaggaggcagaggttgcaatgagccaagaccacacaactgcactccagcctgggtgaaaaagcaagactccacctcaaaaaaaaacaaaacaaaaacaaacaaaaaaaaaactggactccctacagccagtgtagtatgcaccactcacttgccacactgtatgctgagtgacccttccacagcttaaatctgcacataacttcagcctagagccatataatgtccctttatttcttcagtacaatgattaataccatattctctgtacccttcttccctctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagctgattcacctccttggtgagggctctctccctggcttgcagactgctacattctccttctgtcttcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccatcctctgcagtcatcctgtcagtttccattccattctcctatccctggcttgctggttcaatactcttaagtgatttactgctggtgctcttctttttccctcagagataccttgtgatttctttgattctctccacctctacaggttaataagtctaatatttaaaaactctgtagaaggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaaacgcactgccgagaggccagaaggcaaagcgagagtcggtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagagctaacaaaaaaaaaaaaaaaacttatgtttccgcccggtttcgaaccggggacctttacgcgtgtgaggcgaacgtgataaccactacactacggaaaccacaggcggaacctgcacggcaaaatataaccatgaaaatcttagatcagccgtttctattatagtttccaaatccgagatcgcaccactgcactccagcctagacgacagagcgagagtctcaaaaaaaagttgggagaagaaggtgccattttccctagttgcttttcttactgcggtggtgaccgcattgccttcacacctgaagtccaagtgcttccaccctgcagaatatgcagaccgctgggtcactggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccaaaggaaaagcgcaaaggcggcccaaccccacgacctgagcaagccaagggtcgcgggttaaattgcgtttatcagaacagttgtttgctcactgtcccaaagccctcctagggacaaagaaaacactggcatggcaccaatcgcagaagggggcagcattgacacccaggaacaggagtggaaaagcaggaaaagcagggatcatctctctcctaccccgtatatggctgcagacatagcagtggttcttttctccaggacccagtgagtgtgcaccaggagagaaaattatgcacgttattcatggtggcaccacccaggctgaaagtgagcctgtgctgcttgggctttcaggaaggacggacccaactctccctccctatacagagctgcagtgccctggcaatggaggacagaccatggagttgcctgccctggactcggggaagaggctctgccctaaaccccattttagtggtagctgtcagagtggcatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactgaactgcatcctaaactggaccactgaattcaaaaaccctgctaccaaagggcttagtgctagtccatgagataagtttcctgagaattccgtaccctcagcccccaacaagggttagtgtgttagcttttacttccaacacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaaaattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgttggaaatgacagataagaattccaaatacggattgcaagggaactcaatgagatccaagaaaaagttgaagtccaatgcaaagaaatcagaaaaacaatacagaatatgaaagacaagaaaactatattaagcaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccattgaaaagcatacagtcatcagacttcccaagataaatgtgaaagaaaaaatcttaaaggcagctgaagaaaagggccagattatctataaaggaaatcccatcagactaacagcaaacttttcaacggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatataaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaggcatagggtggcaaattgggaaaaaaaaaaaaatcaaactttccatggcctttaagagagacctatcttacatgttatagcccccagaggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttaaattggactcttgactaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaaattgaaacaaatgaaagtagagacacaatgtgccaaaaactctggaatatagaaaaacagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcgagcagaactaaatgaaacagagataaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttgaattcctggaagcacacagcttcttaagattgaaccaggaagaaattgaaatcctgaacagaccaataatgagttatgtaattgaatcagtaataaaaattctactaatctgaaagagccctggaccagacagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaattctcaacaaaatactagcaaactgaatccagcagcacatcaaaaagataattcatcatgatcatgtgggctttattcctaggatgcaaggatggttcaacagacgcaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcaggttacaacatgagcatacaaaaatcagtagcatttctatacactaaaaatgctcaagctgacagccaagtcaagaacttaatcccatttaaaatagccacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcacacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagctgagatcatgccactacactctagcctgggtgacagagtgagaccctgtctcaaaaaaaaaaaagaaaaaatccccatggaaccaaaaaacagcccgaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaactaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcttatgactaagacctcaaaagcaaatgcaacaaaaatgaaaattgacaaatgggacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaattctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcgccacagccagaagagtgactctgagtatatgaatgaggggctacagtggactgtccagtacctagggagggagagacagggctgcaatgaagtctggagggatttaggaaattcattgattgtaccaaacaaaaacttacatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacacgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttccttctggaagcctgaaaactccagtttgcttccctgagcccttttcctgttgcacaactagggtgtggactacaggtcctacccatggaagatggaggtagatacttcacagggaataaaaacaacctagacaagtcatacctttaggtaacagatactttcaaagatgtactttcctgcacccattaaagttttagtctcagctaatctgaaaacctgcggtcctcatgcactgggatagcagtgcaatatggctcaggctcaggttttgctgggcacaccagagtaggccacacactctcatgtgcagtggcttcaggtatggatcagggtctttcccactaattggcttcagttatgatgttgtaggtcatcattcttctggctttaatatgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctccagcctctccctcaggcggtcattgagactgatggactcctccaggcgctggcgcaggttctgcatctcagcaagattcttttccagcaggtcggcccctactgcaaaccaccaagacataggagaggtaggaggtagggaagcctgatcatccctgggcagctgtggggcctgcctggcaactctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagagggggaacaggagagaagggaacaatctccaaggaaggaaaaagatgcacagagagaggaggctgagaataggcctcacccactgggagattttgcgtagggtcaggtttttctctgagaatttaaaatgtcttattgttacactacctgggacacagaaatggagctgcttcaagccattcctctaaatacctgcactcctagctgccaggtgccaggatgtttggctccaaatccaaaagcaatgtttatgggggcaggattggcacgtggttgtatgcacagtgtgtgtgaaagatgtgtgtgaaagagtggaaagagtgtgtaggggtgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtaagttcctaggtagggtggctaggagaaggcactttcaaagaacaagcactgagctggttctcactgtctggctgatctacatattgtcctgtcattttttatgaaccaggttctaacagaggaaccaaaaagtcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaatgagtgttttaaaggtaattatagtgagttgaatagtgtcctccaaaaattcattcagttcacttggaacttcagaatgtgatcttatttgtaaatgggttttttgtagatataataagttaagatgagatgatagtgaattgggggtatgtcttaaatccaacatgactgatgtccttatgagaggagaggagacacagagataaagagacatacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttaggcgtcttcatctccagaactgtgagagaatacatttctgttttaagatgcccagtttgtgtttttttgttttggaagccctcgaaagctaataaagcaatccacggaatgaagactaaggcagatgtcagcagactcatttcccaaggactccccatttcaccctaaagtaactggcatttctcagcctatgacataagcagtagtgttagttgtaatatctgagcatcacagcgcacatacaggaaaaatatggggcccctctcctagcttcctttatgattcccaatgctggaatgaacctggggaggtacttcagaaatgtttctcctaatagcaggactcacagccaatcctaggagttcagacagtgaggggtgaagcattttgttggtctgtaaacaggtgactatttattcaacattctatgcccttgccagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccacagaatagctagtgtactcttgcatagaggattgtagaatcacaaaatacatggcatcttacagctcaatgatgccatgagaacatggccagatcctctgggcccttcattactgtctccctttgagagaaaaacccagctggggtggcagggccataattcagagaaaagttttagagtctttccctttcaaggattattatcaagggctaaagaatagacaagtttctcctctgagcaggtgggagtgaggtttctgtttgccctcaacaacatcacgttcttttaggaactgtatatttaaatcagtaaccagtaggtctctccttctccaatttataaaatatcagatactaattagaatcactgtgagataaagagtaatgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacattctctggccataccacacggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaaccgttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttcagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaatccattatgggccgggcatggtggctcatgcctgtaagcccagcactttgggaagctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactctgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcctcttcccgtctctatcaaggctatcccaaggaccctctcagggaaattctcaggagggacacgctggttggtgatagactcagcttgaacctcacagcatggccccattcactgatggtttagagggtgttacagcaaacttattaggatgatggatgggatctgtaaatgcataaatgataaagatgatttagtgatgaacaaaaaataggaactgttgctgtttaccccagggattccaggattaggtgcacaatgttagcaacactcatgtccctagtttgaaagatgacataattgtgtgcagtgaagaggaactatttgccccctttctccccttcccaacccatgccccccaagaccaagaccatgtatgtgccagaggagatctagtgactgatggcatgtgagactgggaacggagaaaagctacctgaaaaccttggggcttatgctcagcactgagtcctggagctgtgcccgaccaggtacatcacggtggatctacagggcccggctgcaaagatgccacctcttggcctagacaatgcatgagcccccaaaaactggagccatgtggctactcactgactacagtcactgaaggatgcacttcctccttgtcaagctgtggagacgtgctgctcagggagtgatgtggggtagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctgagggctcacaggagatgtaaaggggaggtcaagaggatcattccttcagaggagaagccaaacaaatcatttctgtttcaggatagagtatggagggaaggcggggacagagagagcaacagttgtccggtgcattggctacaaacatcctgaggaaaaacgaagccgtaatgggccccttaaataacactcatgattccttcacaaaacacccagagacccataagagttcaactccaggtatgggcatggcggtacatgcctgtaatcccagcaatttgggagaccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcatgccactgcattccagcctgggcaacagagcaagacctcatctcaaaaataaaattttaaaaatgtaaaaaaaaaaaaagaattcaactcattctgtgaacataatttttaaaatagtatttgccataggccatttaaaacagattccccaggcaatgtagcctcactggtgtcttgcagtttctagatctccttccctaagtatagagacacagtataaacttttgtttgcaagaaaaatttgtagccgttttacatcttccagcgctccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatcactaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggaccagagacttgactacctgatgcttgccttgattccaggatactctgaattttctcagatcttgggttgagtctttagagagcttgtctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgttccttctgtctttctgccaattagtttcagaggaataccatcatccctggggatgcctcctgccctaacagtcatattccatgagggatggaggtgctggtgatcatcatggcatcctcaacccttcttcttggagctcctctccagccagtcctgactctgtcatggtcttaaggtggtgattacaaagcaggacaccaggttgaaaagtgacatgtgaatgggggtggcatcctgtgaacttaggaccttgggagagactgaaaatcttcctaagctctgcggccaacttacctgtgctgaattttctggcaaggctctctgccagctggcttcctttggccagctgctcgcagtagtgctgctccatatagtggtcaaagttattgctctggagtagctcctcaaaggtctttagtgtgttcttgacatgctggatgagaagagcagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaatctctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttatctatgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaggccgggcgcggtggctcatgcccgtaactccagcacttagggaggtcgaggtgggcggatcatgaggtcaggagatcgagaccatcctggctaacacggcgaaaccccgtctctactgaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagaggtcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaatagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatgtttgacaaagggacaagggcaatacaatggagaaaagatagtattttcaaaaaatggtgctggaacagcgggacatccacatgcaaagaaagtgaatctagacacagacttcacattcttcatgaaaacttactcaaaatggatcataggcctaaatgtaaaacataaaatgataaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttacttgttggagggcatgatcatggctcactgaagcattccttgggcatgatcatggtgtgattatggctcactgcagccaaactcttgggctcaagtgatcctcttgcctcagccttccaaagtgctgggattacaggtgtgagccaccgagcccagctatatgattatttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagatatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagtttacacaaaaacctgcacatgatgtttatagcagctctattcataactgcaaaaacttggaagcaaccaagatgtccttcagtaggtgaatggataaattttgatacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagagagtaaaaagatcagtggttgccaggtgttaggaggaaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtgggttcatcagttgtaccaaatgttatcactcgggggcaagatgttgatagtgagggaggctgtgtccttgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattctaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgttttgtctgagatggaatcttgctctgtcatccaggctgaagtgcagtggcgctatctcggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgtgcctggcctagcgttattttagccctaactaacattattctctgggtcagtgaaatttaagtggaatatattgggcagtgacctaatggagcatgaagcaggatttgaatcacttccaaagctgtacaccaaccacttaggcaaagtagtgatttcagtaacttagtatttcagtaactggtgctcacaggcaaatgcgtaatggattaaccccatattatttaaatgcttccaaaaagctataggaaaatggccattaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacgtatgaagaaacaggagattcctacatgctcctggggatccagaagagagaccactcacatgactggaagatttccagctcaggtaaccacaaaggccatatatttggtgaatacaggcaatgttagttagaataaaaccaaatttctctgaataatataaagtcattactaataaaacttttatagatttttctctgaagaaatttccaggaaggtgttaagagaaagccctacaattaaggtatggaggctggctgcaggccctgaaagctgctctgatgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcagggtgggtgctgttatgagaaggaaggggaggtcccacaggtgtttagaagaaaaagcaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttgagatgccagagctcaaatcccatgtcactgggacatcaacaatagtgctatggggaagactcagggtgccagctcttgagtcacaatcacagaattagaatgtggaagtagctacagaacccaaggaagccctgccttctgatagctacactcaatgcaaggctgcgtatttcaccctggaggtctctaacaggggaggccaccccctcaatagccagcttttttacccttttgcttacgttgtcaaccaatttctaaccacagcaaaataacctaagtatacctctccttgaaaacatcaaaacattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtattactttttaatacataataaataatatatcccaatgcgatacttgcttcctttcccttgcagtagcaacgtgtaggggtttcatttaatatgaggtcgatttgagccttccaaactcccattccacccacctttgcttgcactcatgggaaggctcagtctatatctggtttgcccacattcctaggctacagacctctaggactcccagtttgagaggcgccatttttttggagggtagtgaattttgatttctgtctcctttgcatccttcccagtgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacacgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaagagaagaggccattggtagtatatacttgcatttttcttgtaatacttgcataagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattgtagggaatgttaaaatttctcactggtacagttagaaatgaaaacaaagacaataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatctattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggatatatactcaaaagaactgaaagcaaggattcaaagagatatttgtgcacctgcatcaatagcagtattacaataactaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggacattatgcaaagtgaaataaaccagtcacaaaaggaaaaatactatataattctgcttatatgaagtacctagagtagtcaaagtcatagagacaggaaataatggtggttgtgccaggggctagggagggaagaatgggaaattaatgggtatagggtttaggaactttagtctaagaaaggagaatattggatgccagaaattcagttttctttctgttccaagatccctttagctagagcgacatattgaagtcagagttcctaagggaaaatcattgtgtatggagatcatccttgtggatcaaatgtgaatcaatagtagatcaaaagatattccacttttgcagatattgacatttgttggacccgtaagattttatctagtattagatagataagatgtgaaccacttctcaacgctgcagactcaaatactaggaaatactaagaacctcaggacaaacaaatagccagtccaaaaagactcacagactagataagctgtcatctaccacctaacagataatgtatccctgttaaccactatctccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataaggtgcaggattctattagctaagattatgtctcaggtgggcaaatctctgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagtctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatacaaaatatcttggaagtttagctgaagagatgaggagatactctactgctcaatgtgcgccatgtcatctgttgtacctccccttagttaagtcaggagggcaacactccctttattttttattttattttgtatgtatgtgtgtgtgagatggagtctcactctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcggcccctctatttatcagacagatgtatagaaagtttattgtgctagcaagagtatgaagaaaaggattctctgagttgaaaaaacaaattggaatataaattggtaccacttctatggaaggcaaatttacagggcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgatcgagcaattagtaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactacatttctttccaacagagaccttcttggaggatgagaagcagccactagttgacaggaggggaagtgaggcatgtagtcttcaagggagcagaccaccgtgggagttataaaagaccagcgacgcctctgggtgggttcgaaccaccaaccttttagttaacagccaaacgcgctagccgattgcgccacagagacatggctgagctcctaatttcgttctataagagggtaagctgtcactaaacgctagctagcaccatccgccttttgcaaaatgactgggtaatctccaaagcctcggaaagccggagcagtcagagcgacgaatctacttgtttgtcaagtttgaaacctgtgcattgagtgattccgaaacgccccgcaccccgccttgcctgcctcagaagccggcgcttccggagatgccgggatcgcgactcctgttagagcgacttgggccccagggaagctgaaacgcccagggcgctcaattaggacttgttgaattaataatacatttgagagacagaatatacaatcgaacaatggccggactatacgtaaaaatataactctgatccacaacctggggccacctgcccaagaaatcaacttccttatgtacgaataaacaaccggggaagccagcctgctattatataagtcagactcacagggagccaggcagttatctgtagtaacaaacaataacatccataacaatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgacgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctagtcaattgatttccaagtgtgcaatgtcccatggggtaggccacaaagaggcctagagtgcaccatctgtgcggctgcagctcctggctctcaacagaactgagatctaagtcctcatgatctgatcagcttccaagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcctacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatatttttgcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacgtaatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcactgttctagaggctgggaaatccaagttcaaggtgccagcagactctgtgtctgatgagggctcactctctggttcataggctgtgccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagtggggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagtcttaacaaggcttaccttctttcttgtggtaattttttgataagcagtttttaattttgatgaaatccaattttcttattttttgtgacctctaagacatctttcctaccctatgattgtgaatatattttcctacattttcttccagaaacgtgtttttatttttatttttaaatctataattcttcttaatttcatctcctgatctcagcacaatgcttaaccactataaaatccacaacttgcagaccaacagttcaatctcccagaaacttgtataacccttgatgtaacaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcgatctttcttctgtaaaatggggctaataagagtagtcttaggccaggcgtggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggcggaggttgcagtgagctgagatcacaccactgcactccagcctgggcaacagagcaagactccatctcaaaaaaaaaaagaaagaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtttccatttctaatactgaattgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattgctttagtaccttttttgaaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacagctcaataaacctgaaatgtgtacatcctatggtgccaccatgaaaatcaagacatgctgtcacttaatcgctctcatttcactagaggacacatgagctcatgaataacggttgaccccttagccaaagatcctctattgtaccctctggagaaaataaatctctagttaccttaaaagctgatctagaggtaaaatgtctgcaacattcagcaatgaatttagattatctttgaaaaaaagttcattttcaagttgttttttttgtttcgtttttttttttttttttttgccaaagaatttctttttttttctgttacttagtagcatgaagtacaatgtttggtttgcaatttctgttctttgtaggaagaaaaactttagtggaaacaaccagtacttaaagaccattttatgaggctgtcatttacgtattatctcttttgctgtttttgttaaaatgatataaggtgggctttatatgctttctgtatatcctttggaatgtgtatttaaattaaaaacttaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttcctcccacccttgaaagtcctcgacttaaaacccatctagaacatttcctttgctaagactttaaagtattctttcttcaagttaagggcagtttttaaatagttatcagttgcattcttggaattcacagaaagcttggggagaaacaatccaacggcacaagttcaagtgcccaacggggtggagaagggactgcatactcactggttgccaggccgaggttgtccgccttgcctgctttggctgagactggagacggaaactccattcaacagcgactggaggactgaaacagggcgcaagagggcggctgcccttcacctaccggtccctccctgccttggcgccttcggagttcggactgacccgggatgttgctggagcccgcaggaactgcaaactcaccgcgcgcgtccctgcacacccgcacctgcgcctcgagaactcctggccagttgaatacccggtcccccgccgagcttcgctgcaggtcacaggaaagaggtgcagggttgcgtacccggcgggagaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggatggagggagggaagaaagatgaaaaaatcaaccaaaaaaagaacatgatttcctaactaatcggatgtgggtcatgagagaaagacctgcgtcgagtttttggcctgaacgtgtggagggtggagttgccattaactaacgtgggaaaaggcaggtgtagtacgttttagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggcgcatctttaggtcggtagtgaggtgcggccgggacgctgcaactcgctccgggacttgtaaacctggcaggtgttcgaagagggccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtaatttctgctgaaacaattgaaggaggaaaaaaaaaaaagtatgtgctttgtggttccctggtagtctagtggctaaagtttggcgctttcaccgccgggactggttgattccagatcaggggactgggtctcggcctcactgtgaggtattgttctttcctgtgtttgccatctgccaccgctgtggctcaattattccaagactgctggagaaatggaattaatgtcgatcctaaaatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatagtctcatgggtatgcttgagactttaggcccttgggacacctggtgcacagaagggtcccaaaacccatctttggaagtgttggcagagtaaataggcaccagtaataaaggcaacggcgcctgaagacctaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttattggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatgtatacgtgtgtgtgtatatatatatataaccatatgtaatttcaaaaggtaaattaaatataatgggacagtgttggtaacctcttagatagtgtagggctaagatagctgaatttatggcatggtgttgtatacttcagatatctatgctgtaatattaaaatggcatttccttggcccactaaattgtccatttcctggcccaaaaagatacgcgaaaggagtgaaaatgggaagaaaatagccttttgaaggacttgcctaataaacttctcccttagcattacttggagtgacatcagaaaattggaatgaagtaattgtgtaatgtaaaaaagacaaattctctgctgtctttctcccccaatccttaataaacaaaggaggaaacctagactcaggttaggttttctcttcttattctttacataccaggacaagtactgagcttgtttgttactatatggggacttagtatattgtacaaaggggtgtggctattactatcccttttctaccagagcatcaaaactggtaacttggctggtgttaacgggagcttctaaccttgaattcccactccatgtgacttctttctggttctctcttctcagagaacttgcagccatcagattcatttggagaagtttgataaaggttactttacgcttagacagaagaaaaaaccctaaggtcttgaactgagccttatcctctgatacagtttactggaattccctccactgtggcacaagccctgctgtaaattgtgattatctataccttgtcagttttatctatgtatatatcttttacagtaatccccacatccaccagagaacctaggttattggcagaatgaggtttgggaattctggtcctctggccagacactatcagttagtactctgattccaccatttttgaaattatatacaacaaattttaagtattgtttattttggagagttcaggttaaaggaaatgaagactattattcagtattatttctgtaattttgtaattttaaccataacataggtttcttatcaaaacgtatggaagccagaaagcagtgaagcaacaatattttctccaaaacgaacaggccaaactttggcaggagtgacaaatctggcatgcaatggtggcttctatatcagaaatcaagtcttttactttgtgagagcacgagtttttagttttttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgccccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagatgcagtagagagacttctttcgttaaagtacctgagtcaggttgaggggaagagaagaattaggagcacaaagagagcaggcacaccacaggaagcacaactctgcaattgcttttggttttaagaggctgtccattcagtttttttgggttttttttttccttttcttgaaacggagttgcccaggctggagtgcagtggcatgatctcagctcactacaacctccacctcctgggttcaagcaattctcctgcctcagcctcccgagtagctgagattacaggctcctgccaccatgcctggctaatttttctatttttagtagagatgaggtttaaccatgttggccaagctggtctcgaacccctgacctcaggttatccacctgcctcggcctcccaaagtgctaggattacaggcatgagccaccatgcccagcctgtccattcagtttcaatgaactttaaacaacaaaaaatgccatttgggtggctggtttcagtcttccctgtcaatgctcagcctccaaatattcactaacacatagaacaataggaggactgttactctcctctcacacctactacttgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacacccataattccacagcatgacaccaaactggagttactagatgacaacccaagtggtgggttgctctgtcaagaaggggccaattttatattgcagctaggcagttacagtctgtagctgtaccattgaggggatcggggcaagatgcaaatttccatggcttaccagaaacaggtgagaaactgcctgctggtagcctgctgcaagacaaggaggcccccaaaagagatgagtaagaaatagtcttatgataatggctcacaagactacttcccttaccatggtccaggagggcatttggtcaaggtttgagtcatagtatggttgagccttgcctatgtaaagtttaagcaaagccattcccttgtaccttgtaccttgaagagagtttcattggatataatatccttaatttgcactttcttctttttaatgagtaaattgcattttattttattttattttattttattttattttattttattttattttttgagatggagtctcactctgtcgcccaggctggagtgcagtggcactatctcggctcactgcaagctccacctcccaggttcacgccattctcctgcctcagcctctggagtagctgggactacaggcacccgccaccatgcctggctaattttttgtatttttaatagagacggggtttcaccatgttagccaggatggtctcgatctcctgacctcatgatccacccaaggagtctctctccctccttgtgttctggtctgtgaatggctcacacttgaacttagtgtaggctcctagtgggaggagcaggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactggtggaagcctcagggcaaggccttcacttcccagtgacactgttcccaattccctccagcatgagctgagcctcctcaggctgtggttgtgcagcagacagggtgtgaggaaaccctgctcaaccctggttacccaggatggcactgagttctaaaaagcaaaggttatgtggtgaggggcctggctgaagacctggtgtggtacttttgtgagcagtggcaccaatagaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaaatacccaacgtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagctggccacccaaccctaatcttcttcttatgcaaatgggttttctactttactcgcaccatgttgtctgctccttactgtacacgtggttagaaaggaaaagggaagatggagccaccatgttgaacatgcctaccccccaggtagccttgtcctattggcacagccgccagcagtcacctgtgcaagcttccagcttgcttatctatgtctgcagctccattttacaggctgctttttgttagaaaagaaattatttggtggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgtcggccttgtaggtgtggggtatctctagcaccagaggatcattgaggttggggatgcagggcagtgagcagatggacaagagaacttttgacagtcaatgctggagaccactgagaccataggatgttgaagcagatgctgccattgctattgatattggggtgataaattttggttgtgaaagcaacctttgggggcttgaacaggcaatccataggaaagtggatggtcaggaagaaaacacctccttggcaaggactgtcattaattatcacccagaggccccgtggagcactgggcaggaggattcgtctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgcttttgtaacttgttccacagtgatgcctggagacctgagtatgttttatctttaaaatctaataatgttactaggatattgtcttgaagttgatcatcctggtttaatttttgctgccactttatgggctctttcaatgtgcctcatcacataagtaatgtcattttcatttttgtaaatcaagtctcctagattgttcacctgaaagcctgattctcctttagagaaaaaaatgctaaaaaacaaaacaaaacaacaaaaaaaacaaaacattatatatcgcattacaattttattcaacaaatacagaggtttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggagagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaattaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttcctcgctccatagtgaggcgtgacccagcggtcagcccaaggtctagcatgcgaatcagggacgtgatggttctttgggattctagggatctacctggagaatagatgaaagtaacaaaagttttacataccaatattcaaaactgcatcaaactaccagaaacacttgccactttcaaagatagactatgctaagtagctccaggtgtgtgccaccatgcctggcaaatttttgtatttttagtagagactgggtttcaccatgttggccaggctagtctcaaactcctgacctcaggtgatccacctgccttgacctgccaaagtgctgggattacaggaatggctcttgactctaactgcaaggtccctagatcattagatcatttcctgaatatcttatgcttcaggcattggccatcacttgggttaccattgtcataaatcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccacaaatccggctcttatgtgtggtcctggagaaacaattgaaatacaatactgaaaaagacagaaattgttccaaaagaagctttttgcagtattgactaaaagctaacagtagacatccaaaaccaaggtttttacagaatacttttactagacaaaactataaatattaaaatagcttatttgatcaaactttaattccgaaaaaggctccttccaactgcgtaacagactcctatagaaaaacatcagaaattcatccaggttccttgtttctgatcctaaatcttcaatttaggacctcaacctcaaactgttgctttagtggctctgggaaggaagcactaactggcagcataggtaagtaaagttttaatctagggaagaaataagaagcagaatcagaattagaattagaagaaagagggaatatgctataccagaatatcataggcaaaaaaagaagacaaagaaagaggaaatgaaaggacagaaggtaatgctaatggagttagttatttgtggccgttttttgtaaaagagtaatgatcagtcttgtaatcattataatactattatttgctttctaaaatgtctaaaatatttgaaggaatttatgatataaaaagatgaataatgcttgcagtcagtgtttcattgtttgggagaacccagtttcctcagttaatacactttcgtgtaatagctgtttaaggagtaacatggtttaaagacatattaatggctgaaatattaacatattggtcttttgatgaagttcaaatagagagatttctttccccaattttccctggaaagattaaactgaagagaaaaatctggaaagtttgccccacatgttgggtctgggagtcattatgattttttcaaagacaggagttgtgtatgacatggaatcatgcttcttctctagttgagaagccaagctaggtccaggctgagtcataaacttgaacccaacaaggaaatcacccttcacactggccttgcagagctttggctcaatctgttctctgcccaacacccaagacacatactagttctggccaacaaaccttcacatattgtctgtgtcaaccagagctacatttattccgaaatctctttctaaaatacaaacctgtactttctactctcaaccccaaaatttacaagaggcctcatatgcatctcagagtcacagatgctaaaactcaacacaccagtgagttccctgtcagcatcatatactaccctctacctcaatgatcagccccaagccagcatctcccaaagagtagtgtgttgctgtgggtgtttcaacagatcactaaaacctgcttctacccctgcctagacacttatcctcactgctatgcatcctgctcctcaaatcagatcttgatatcttctttaaacactcccaatctcccaacacgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtatcctgagtgacctttccacagtgtaaatctggacatacctgtagccttaaatcatatctaccaacatagtagccaagcaacagcaatctcttttcctttggtcattagagtcctagagaccaagaggatgttgggaaaagaattaccatggatcagctctcagaggcagtaggttctggactcatgctggctttgatacgtgtgcattggaaaagctcaagtacctggcaatacttggagattaggaagaaaggatgaaaataaaccactgcactaaataacatgacaataatcacttatacaaaaattttaaagataaggaatatttaaagatttattagtttattatagctttatagttggagagtgaagaagaaaataccaaagctttttgtcttaacaaaatggtgcagacagattaacatatattgtcacctatgataaccagtcagcataaaaagtatttagaaaggaatggttatattctctaagagatatattctgatgtcatgttttttgctttagagtctattaatatagccacctttttgttaatgttttcagtcaagctccttttctcgcctttcatttccaacctttctctcactttctggtttagatacaactcctaaatatatcatatagttaatttaaaaatccagtgtagcagtatttcgggggtttgttttactggataatttggtccacttacatttaatgtaattgttgatatatattaattttaaatctaccatctttatttttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatccttaatttttttttttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtaataattgataccgttatcctcttcctgcacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttactctttatttctgctatgtctctgaatttccatatgtaatcatggtccttctgcctgagaaacatcatttagaatttccttttgtgttggtctgcttgtgaaaaactgtttcagctatttttctctgaaagtgtctttatttgctttaattattggagattatttttactaagtatgtaattctggaggcagttattttctttcagcatattgaagatatttacatttgattgtttcttttcagaaggcagccaattgtctcgctgctgcttatttgaatgtaatgttcctttttttcctctgttttttgtctttactatttttgtctttgtttttttttttttattgtctgcagttttactactctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaagtagactttctcactctatttgttatatttttgtgtttgtgtattaaatattattttttctccttgttatatattctgaatttttttcttcttcctcatctcccactttactagttctcttttcagctgtgactgctctcctgttaaactcttccattgagctcttaattttgttttgtttttttttttccgaatttctgtttgcctctctctaaatctattctgtcatttttttgttgtttccaattggtgtgtaaattgttaacaaaacccttttctccttctgcatgataatttgaccttaattaactttccagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctgatagcaagctataattcttatcctacatctctcggattaatctggtgccaagtatggcctctgagattcttgtgagcctgaacgttaacttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagttcatttttatcccaagattatagaaatgtaaggtcctaccttattgtaggattattctcctgataaactccccaacttgggcagactctggtcttctatttctgtcccattagtcacagaaggctgtcaaaccctaatatgcaggtcaggaaatgtccttagccaaaaaatggcttctctgcttgcttacggctctgggttccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgttcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatttgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactatgctgccaaagtgactcaaactcaaaaggacaggatgagacttactcagaacttcgaggaagtgtagagaaattatccaccactttttatcctagaggtgcttttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaagagtcaagtctatgacttacaagcttataaagatccctcagatgagttatgtacatggattgagaatcagaaaaggaaggatgctctctcaggagatagaaaaaccagataaaaggaacaactgaaattatctgacccatcccctcatcgcctgtgtagaagggaaatgcttactttatctaaccagtggataacagacagcctctttcattttggagctaccaaaaagaaaaataaattgtggtttggttcagttcccttttgaccagtatgttcttgaaatttcgaaaacattttactctttttccttttagtgtttcagtgtggataatttcatttgatctattttcaagttcattttttaggccaaaatttgtcaaatattggcaatttcatatgattcaacttaatatattaacctaatgtgccaaattcaaatttgtttctatactactaaataatatcccccgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttatttaagctttatatatttactttttacctgttaattgttgtaatcacccactaaagagtaaattctggctgggcacagtagcttacgcctataatcccagcactttggaaggcccaggtgaatggatcacttgaggccaggagtttgagaccagcctggccaacatggtgaaaccccatctctactacaaataaaaaaattagctgggcatggtgatgcacacctgtgatcccagctacgcaggagactgagacacaataaacgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtatcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatgtaggaggatgtgtatgaatgagcatgtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcctttcttacaatcccggagccagcctcatggccccctctcaaaggcatgagcatcagccagtggacacctcttcttcagagatctgagtccctgcgacactaggtacttcctctgagttccaaggccaccagcaacctccttctcagaagccatcctcccagttatgtgtggcccttcatccaagttaccaagttctaacaacccaaccattttacctttgtttctacaaccctagggttgatcactgcttcgctttctacacttactatctctgtgttacatcagttccccttttgccttcttagacctccaatacctgtataattccttgtgttaaattccctctggtatactgttcattttctatttttttttttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgatcctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaagagacttgattaactcacagttcagcatggctggggagccctcaggaaacttacaatcatgacagaaggagatgcaaatacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttcccaaaagtcccccaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagagattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactatcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagatcttgtcctctgcacacctgcaggaccaacaccatgtgaaagctgccaaggcttggggctcgcacccgctgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagacactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagactgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaaaccccttataaaaccatcagatctcgtgagaatcattcactatcatgagaacagcatgaaggtaactggccccatgattcacctacctcccactgggtccctcccatgacatgtggggattatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttgtaaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaaagaaatgaaaaagcaggaacacatgatagggtagtctgagctctgtacaaataggaacagtaacatagacaaggagtaattagagtaggctgaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaacattattgaatttttatctaaatgtgatggaggatggacaggaagagaattactgattactctcagtcaggattcatcctagcagcaattatttgtaatttaactgaaataagtccatttgactgaagagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaattgttatacacccttcctcacagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattattttattttattttattttattttattttattttattttattttattttattttttgagatggagtcttgctctatcacccaggctggagtgcagtggcacaatctcaactcactgcaacctctgcctcccgtgtttaagcaattctcctgcctcagcctcctgagtagctgggactacagatgcatgccaccacactcagctaattttttgtatttctaatagagatgaggtttcgtcatgttggccaggctggtcttgaactcctggcctcaagtgatcctcctgcctcagcctcccaaagtgctaggattacaggcattagccaccgtgcccagcaattcttttggaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagactgccatgtaggaaacaggatgtctctaaagtgaaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacaaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtacaacatctgctactcctaccaaatgctaagccactatgaggatataatgctttatttttatttatttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgtttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacgtgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcgcagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaaatttttttcaaggaatagaaccactgcacatgctcctcctgatcccccaaagtgtaagattttcatgcaaatagctatctcccaggacttacattagtaaggtatctggatataaaaatcagtgttccctaaatcagctgtgtttccattatatcaaaaataaacttttagaaattaccatttgaattaacaaagatacacacacacacacacacacacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatcatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagaaatagacaaaagtgcccactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttcaggccatgatgggaagggggagctgaacatgcctcatcataccctcctcccttttggaattactggtagaacagactctaagtctgataaaaaaaaaaaaacatttacaatctattctctctgaagtctgctgcctggatacctggaggcttcatctgaatgacaaaaccttcgtctccacaaccccttatcacaagccagatattcctttctattgataataaggaattgccaatcagaaaatctttgaatctgcctatgacttggaagccacctcacccctgcctgctgcttccagttgtcctgcctttccaaactgaaccaatgtaccttttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcacatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcagtaccttttaaagatgttgttgctacattgtcttctcacttgcattatttccaacaagaaatctgatgttttctttgtgcctctgtgtgtagcatgtctttttatctccgatcacttttgagattttctctcactaactttcagtaatttgattattaaatctttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagatagattaacaagagaaaagcagataatcagggaaaaatgagtaactctcaaagaggtggcctagaattttggcttatgtagcatcttcaactaaaagaaagaaagaagggtgttgggaaagcaagctatgggaaagtgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactccgagagggttcttggatctcatgcaaggaagaagttggagtgagtccatagagtaaagtgaaagcaagtttatttaagaaagtaaagaaataaagaatgactactccataggcagaccagccccaagggttactggttggctatttttgtggttatttcttgattatatgctaaacaagggttggattattattcctttccaggaaagggggggtgcaattccaggaactgacagttcctcctctttttagaccatatagtgtaatttcctgatgttgccatagcacttgtaaactgtcatggtgctggtgggagtgtcttttaacatgctaatggttataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcatttttttttaaccctctgtttcattttggattgtttctattgctctgtctttgcattcattaatcttgttttctgtggtctaatgtgctctcaatcccatccagcatactggtattcatctctagaagttggcttttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacatgcacctgtgaaattaaaaaaaaaaagaagaagaaactttttatctgaggaatgtgagcccctttaaattatcaggctcggagaggcattggaatgaaactgcagtcacatcactcccccttgagtgattatcttgtaaagccacttgctatacgggctccagactaactgatgccaagcagccataaaataccatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtaggtgaggcaattgcagggctcatcttttttcttccctatctctcaggggtgactgtcttttgttgcctgatgtccacagtttcaaaaaacattgtttcatgtattttgttcttttgtttaattttgtttaattttgtttcaggtgagaggataaatccagtctctgctactccatcttggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatacactaagtgagggtctttcagaatagcgcttcagtgtctgcacctgactcacactattaggcagttaaaagctggggaatgagctcatgtgaagagtttttccatttcagatgatagctatttttaggaacacaagctacataaatgttttaacccttttcccatccttttcctcttgctgctgtgatacaggaagaaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacatattcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaactcctgggctcaagcaatccacacaccttggcctcccaaagtgttgggattacaggcatgagccactgcacccagcctatctcatcttttaaaaaaaacatatcaaataattgttcataaatcattttctgtagtagagagcaatttttcttaaaattggcaaataagattttgcatctacctttgagaaaattgtatttgtaaagtgattttaaaagaatgaagcctatgagtatgatggcattataaaagtatcagtggccaggcgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaagtattaatatatggaaatacaaatgtcatatatagatgtaaattctcctaattgttcttctgagcatcatgatttttttccatgaatttttattttaagttccagggtacatgcgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcatggggtgggcactgttatactccatcagtgagtacgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagtgatgaggataatgatcatagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgctcgtatagcaatcctcaaatctcagtagcatataaaggtaagcatttagttctcacttacaagtttgcagggcaggtgaggcagctctgcctcaagccacaatgtctaggacagctctgtttcgcactgtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacataccctcatgaggctgtggagagagtgtagattcagggagcggtgagaaactggggccagtacaccaacttacagcatgatttgtcatcatttttcattctctgctagtaagattgccaaagtctctctgcactcattgaattcatttagctctctttagctctctttttttagctctcatttagtttccatttagctctctttctctcttaccacaatacctaaaaatctttttatggggttacaactctgtctcaggagccacctcagtttggtggcacagagctccccacttgtactctgaaactcttttcttgaagatattgctatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagaaacttctggattcaaatgattgtttggaggcattagccaggcattgaaccaattataaagagtgaggttttgccatattctaaccgtaagaaacagaaacggtagagggtaaaaatagaatagaatgtcaatacaactttagccttttccctggattctgagagttcataacctgaaaatcagagattcaaactgggagagatgggctaacaggtatgagcatgggaaaagcatgtttcaagaatttgagatgtatttcccagaaaagcaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagaaggcaaaagaaaatattaataaatgaattattacgcacataatgttttgtatgtacatgtgtttacttttaatacaaaagtaacggactaagttaacatagatgttccaataagataatttatgtttcatttttggcttcaagtatcctcagggttataagtatcataagctgagaccagctgaattggtttgtgggttgatgaggccctatgcctgatttgaatttctcttgaatggtctgcagccctggaccaagttgaagaagccatgagagtctcagcttttttccttaccccattatgagataaactcattccttaaatatcttgctcatttgataaaacttggcacctttctcctttctactggtccctaatacttactacctgtactgtaagctcaaattttttgcaatttctgcctttattatgtaacgtattccactggaatatgtgttacaggaaaggggtcccgatccagacccctagagagggttcttggatatccagcaagaaggaattcagggccagtccataaagtgaaaacaagtttactaggaaagtagaggaataaaagaatggctactccatagagagaacagccctgagggctgctggttgcccatttttatggttatttcttgattatatgttaaacaggggtgggggggtggaccacgcctataatcccagctactccagaggctgagacaagatcatttgaaccccggaggcagaggttgcagtaagctgacatcgctccactgcactccagcctggaccacccagggataatccgtcccccgcaccccgcccccccaaaaaaatcactgccagtaaggaacaaacagccaggacgaagtactaagatgtaaagagatgtaaaatagcccgggcgcggtggctcacgcctgtaatcccagctctttgggaggcctaggcgggcagatcacgaggtcagaagatagagacgatcctggctaacacggtgaaaccccgtctccactgaaaatatttttttaaaaaaaattagccaggcgtggtggagggcgcctgtagtcccagctaatcgggaggctgaggcaggagaatggcattaacctgggaggcggagcttcaagtgaacccagatcgcgccacggcactccagcctgggtgacagtacgagactgtgcctccaaaaaaaaaaaaaaaaaaagaaagatgtaaaataatgtgatacattctgcaagagttatgacagagtcagaaaggggcaagcatgtttcttctctaccctgaagcagccaagggagaagaagatatctgttgccaacgctggggtgttacaagtgcacactgccatgcccggctaattttttggattttagtagagacaaggtttcactgtgttgcccaggctggtctcgaactcctgagctcaggcaatccacccgcctaggcctcacaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtgtaagtatgtccatttacagattgggagatggaggaatcacagagcggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgtgcgcctgtagtctgagctacttgggaggctgaggtgggaggatcgcttgagcctgggagattgaggctgcagtctgcagtgagttatgatcacaccactgcactccagcctgggcaacagagaccctgtcttaaaaacaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacgaggaaaattagagttatcaatgattttgggggatgagtggagtgtagttttcataggctcaaagcaaagcagggctgtgtgaaagggtaggcataggatgggactttgcagtggatccagggtcttgtttcctcagaaactacaacgttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggagaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttatttcccccccctttaatctatattttattttatttattttttacttttttgagacggactctcgctctgtccccagggtggagtgcagtggtgcgatctcagctcactgcaacctctgtctcctgggttcaagcgattctcctgcctcattctcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggtcttcccaagtgctgggattacaggcatgagacaccgcgcctggcctaatctatattttaaaaattgaactcttccatgtacccctgaacctaaaataaaagttaaaaacaaacaaacatacaaaacaacaacaacgacaaaaaaaaaaaaaaaaaaaaaaccaggccgggcatcgtggctcacgcttgtaatcccagcactttggaaggccgaggcgcgcagatcacgaggtcaggagttcgagaccagcttgactaacatggtgaaaccccgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaaaaaaaaagagagagaattctgtactttgtaattagaggggtaattcattaattcatgtcaggggcatattattttatttttccaaatgctaggaagcaggtatccattttttgataatataaattttgggataattggcagtcatctggctcacagggaaaacaggaaaaacaagaaacctaaataaacttcatattgatttcccaaaaaaattaccttttattttcaacccttatagaactcaacctgcatctctttgccatccatgttctttttttttagagactgggcctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttggacctatataagaatttcttttggataaaaactcaggaacagaagtgctgagaagccagaaaccagcagttctgttcagagttttatttacatctaattgaactaaggagtgtcaggctcccctccagaatgcttgtcccggacttccaataccaaggtagctggactctgagcccacatccaggcccagtcctcgggtcatccaactttctaagttttgccagactgcctggtgtaaagtggtatctcagcattgctttcgttttcattgttccgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattttttatttatttatttattatttttttgagacgaagtcttgctcttgtccccgaggctggagtgcaatggcacgatcttggctcactgcaaactccgcctcccgggttcaagtgattctcctgcctcagcctcctgagtagctgggattacaggtgcctgccaccatgcccgactactttttgtatttttagtagagacggggtttcaccatgttggccagactggtctcaaactcctgacctcaggggatccgcccccctcggcctcccgaagtgctgggattacaggcgtgagcgaccgcgccaggcctcaacctacatttcaagtcaccatctgtcacaggataccttccactctggctctggatatgggggtcacctcctcacaaagacagacaggctgtatgtgcatacacagaaagattcagaagaaacatgaagacttttaaaatcagtgagatgattttaactttctttaaatcagtgagatgattttaactttcttctttgtagttttctctagccagttttaaaaactgtaagttgtaggccgggcgcggtcactcacacctgtaatcccagcactttgggaggctgaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgaggcaggagaatcccttgaacccagaaggcagagcttgcagtgagctgagattgcgccactgcactccagcctgggcgatagagcgagactccatctcaaaaaaaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgttgttgagacggagtctcactctgtcgcccaggctggagtgcagtggcagatcttggctcactgcaagctccgcctcccgggttcacgccattctcctgcctcagcctcccgagtagctgggactacaggcgcccgccacccatgcctggctacttttttttaattttttttttttttttgtatttttagtagagacgggttttcaccgtgttaaccaggatggtctcgatctcctgacctcgtgatccgcccgcctcggcctcccaaaatgctgggattataggcgtgagccccagcgcccggccaatgtaaatgtatttcttactgtagacttgaggtcaggagagtgggctgtactggacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagccttttcttctttccagggttgttgtggactcaaacgagaggctgttagtgaaaggtttttgtgagttatgaagctcctaggaacccaattatttctgctgccttggccacatagtctagaagaatctctacataattagcatctagagactagataatttacccattattttccatgtgcttgtcttatttcccagcatgacggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgtccaaccattcaggcttttcattattataggaagcatctggccaaggaccaccaccatcttcctgtcctgcccctgaagctgtgagttccccaagtggagacacagcctgttccccaacacctacactcatgaacatgggagggttggtcaaaattgcacagctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaactaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctccctttttttttttttttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgccggctaatttttgtatttttagtagagacggggtttcaccatgttggttaggctggtctcaaactcctgacctcaagtgatccagccgcctcggcctcccaaattgccgggattacaggcatgagccgccgcgcctggccttgctttttctcttttaaaattactgttactcatggggtatctgcaggcctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattagggatgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtccacttgcaaagacgacagatctctctacaaattctgggctgagcaggtgaaggaggctggtcaggcccatgaaggagcctagtcagccgtaaggaaaggttcactgtggggcccccgactttccattcctgatctcctttttacctctgctgcccacttcctttcctctttccctccaagtataccttatactctgctcctgatgacactcagatctccccccgcccccccgcccccatcaaatataaagagcctagtgacttttgtaagaacggtgtattcatttcctagtgttgcattaataagttaccataaacttagtggtttaaaacaacacaaatttgccgggtgtggtggctcacgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactccgtctcaaaaaaaaaaaaaaaaaaacatgaaaccaaacaaaacgaaaaaaaccacacagatttattctcttaccattctggaggtcagaagcccaaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagattccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgagaagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcccagtctgtaaagtgagaatgataaaacatctgccttccttgcaggattgttgtggtgatgtgtaagacaaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatcagagtaataacaactggtggatgtgttctcctaggtagagaacaggaatctcaatttttaatgttgggagggactttatgcatctttttgctttcaaaagcaatttctggctgggcgtggtggctgatgcctgtaatcccagcactttgggaggccgaggtgggtgaataacttgaagtcaggagttcgagaccagcccagccaacacggtgaaaccccgtctctactaaaaatacaaaaaattagctgggtgtggtggcaggcgcctatgatcccagctacttgggaggctgaggcaggagaatcgcttgaacccgagaggcggaggttgcagtgagcagagatctcgccactgcactccagcctgggcaaccgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaattttttctttctttctttctttctttctttctttctttctttctttctttcttctttcttttttttttttttttttttgatacggagtcttgctctgttgcctaggctggagtgcagtggtgcgatctcagctcactgcaagcaccgcctcccgggttcacgccattctcctgcctcagcctcctgagtagctgggactacaggcacccgccaccacgtccggctaattttttgtatatgtagtagagacggggtttcaccgtgttagccaggatggtctcgatctcctgacctcgtgatctacccgcgttggcttcccaaagtgctgggattacaggtgtcagccaccacgcccggtcaatttttgtatttttagcagagaggaggtttcactgtgttggccaggctggtctcgaactcctgacttcatgtgatcggcccaccttggcctcacaaagtgctgagattacaggcatgagccatcacgccccgccctaaaacaccaaatcttattaaatctatattctacaactctgtcacatccatcacttcatctctgcccactcctagcactgacttagctgaggacatcatcaattctgatcaaaggaccctaagtctaagtaacaataccactttcatggtaggctttccccggaaccagctggacataatgagaattttcaagagaatgtgaattgctctttacttgattttctttttttttgagatggagtatcgcttttgtcgcccaggctggagtgcaatggtgcgatgtcagctcactgcaacctccacctcccgggttcaagcgattctcctgtcagcttagcctcctgggtaggtgggattacaggcgcccgccaccaagcccggctaatttttttttttttttttttgtatttttagtagagatggggtttcaccatgttggtcaggctggtctggaactcctgacctcaggtgatccgtccgcctcggcctcccaaagtgccgggatttcaggcacgagccaccgttcccggcgattttcttttctttaagactaatctgaaagtgcggaactctgtgtacctgaaatgattacattttgatattgacatgaaaaaattgggtactactttgccccagtttctcaacccaacaaagacattccaaaagtttcctatggggcctaggaaggttggccttcacaggatagtggcaggagtgttaactttgtcctattaccaaaaggtgtcaaagctgttactaaattgtctgtgtcagtatcggaaaccccgacagcactggagaattcctcatggtccttccagaccatggtcacagtgagaagcagattctgttgccctggccctgtggggaaatccccaagatggctgctgatagttaaggaaacagtgtcctgccatggcctgaccctaggctgggtgagagagagtgggtcagacaggctgcacttcctcagtgagtgtgcatacacctgttcgcactgcctatcgtttcctcacccagtgtgagagcagggggctcagttgggctgagtggagaattcatgggacctttccatggtcaaggcccagagcttctattgtgtagcatccctggaacagagaacaggaggcagtcacaaggccccagcttcaacctttgacagtacaccagaaaagaccaagtagtgaggcctccactgtctcacaccagccaagaaagaccaggtcttagactatccagtgttcctgcctctctttcacggtgctgtatctggggaatgaatactccattgtcataggaggggcagatgcgggcggaagactcagaagggtcaaggtaggacatagacattcccactaagctagagacccctgaactgccatagccatgacatgcacacgttgtcctcaaatcccagggccatgggcaggtcttggatatctttggaattttaagttggttggcatctgtctagttttaaacctgatttaggttcagttcaaccagggagtatgattctttggggagagggccctgacctagaaatctacatgctcagcggtctgctcagccactaatggctctgacacactggaaaggcactcaccctctgggagtttcagactgtatctttgaaaacaaaattcagtggatggggtgcaaaggtattgtcctcaacagctctaagttactacttctaactcacagagcacatatcacaaaggatcccactatccattgtcggtctgagcagggaatgagactttggcagaccatgaatcctgtattaatttctagggggactataacaaaataccacagacttgggggtttaaactgagattgcaccactgcactccagcctgggtgacagagtaagaccctgagtcaaacaaaaaaaaaaaaagtgtatacatgggagcactctgtgatgagtaactcaaaggagtggttagaatttgggatctacctagcagcaggggaaaaggaggaggagtaaaggacatatggaaaaccaaatgacttttgaaaagataaatgggcccttagaatagatggaagattcgagtcttgtgacaatgtctatttgggtgtggtgaccacttctcatctccgaggttagatttgcttctagtgctgaagaagatttatgacaactgagttaaaaatttgagatttgcgaggaggatctgctattaaacaggtaagggattttagctgtttgtttcagctgaaaataattcttaagtcgaaactggcacatttggaggtagcatgtcctgatccccttaaaaagggaactgcacagacaccgtatctctgattctgcccagggtcctgtgccctctgacaccagaaatcaccacttctctcagccttgttttgcggttgttttatcatgttgcaatttggttatgtcttttctaatagtgtttaaaagcaatcaaaggcaggaacttttccttttataaactattgttgagcttatattggacactgaactaagtgtcagtttacaaaaatgaataaacaaaaatcactgccagtagggaacacacagccaagatgggggagtagtaagatgtaaagagatgtaaaataatgtgatagattcggccagagttactaaagagtcagaaaagggcaagcatgtttcttccctgtcctgaagcagccaagggagaggaagatatctgttgccaatgctggggtgttggtttaggcatgtagatgctgtgatgcgcagtggaaccgttcaatgagcagacaggagaaccagctttatgcggggagggagagaattgctcccctcatcccccgtgagtcacaccctggagattataagtttaaacattttgatttcgggagattttgagttttgggcttaaaatgactgaagaaccaccaggtggatctacgtgtctcgagtccagaagtctgaatacagatttacgatttatgagcacacagaaggtggatccaagggagagattaaacagggcacagaagagtttttaaaaataatatttttcgggaaaaaaaccccaacaaaacacgattctttcagcagaaaccagaagattttctcatagactctcctacagagagccctgataaagtaataaacatgctaacagtaagaaccccaaccaatttcatagggcagtttgcggtaactactcccagtatggagcagacagtcctcttgcaaaacccgatttagcaaactttgctagctccatgtggggcctccaaaggacacagctgggcactaaatcctggctgaaaacaaaggccgatttagaggatccgtagaaacggatgcacagaatatccctcagtcttctctatgtagcaggccctccatatacgcgggttccccaagaccgaaaatattaaacaaatgaatttcttttttaaaaaaaagtacaacaaaagatagtaaaaataaaaacagtataacaattacttacatagcatttacactggattaggtgttacgaagtaatttagagactatttaaagtacacgggaggatgtgcatagttatgtgcaaatactacgccactttctatgagagacttgagcaacctggattttggtatcggcgggggccctggaccaatcccctctcagttctaccgagggagaactgttttgtttcttccagcacggctttgaccgacagtgtgttgggattcgctgacgtccatgagaaagcttggcagcatgctgagaccaattttcccagggccagaattctcctgtgtgagctaaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccatttttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtccccccgaaagatatgttgaagtctaacccctagttgcttagaattttgccttctttggaaacagggtctttacagaggtaatcaagttaaaatgaggtctttagggtgggccctaatccagtatgactgatacccttataagaagacatggagacagccgggtgcagtggctcacatctgtaatcccagcactttgggaggccaaggcaggtggatcacctgaggtcagttcgaggccagcctgactaacatgatgaaactccatctctaccaaaaatacaaaatcagccgggcgtgctgacgcatgcctgtaatcccagctactcgggaggctgaggcaggaaaattgcttgaacccggggcacagaggttgcagtaagccaagatcatgccactgcactccagcctgggcaacaagagtgaaactccatctcaagaaagaaagtaaaaaaacatggagacatacatgaaaaaactgaggtagagattacagttatgctgccagaaaccaaagaacaagtggggctaccagacactgaaagacaggagtcttcccctagtgggtttggagagagcatggccctaccaacacgttgatttcaaacttctagcctctaaaaccatgaaagaataactttgtgttgttttacgccatacagtttgtggtactttgacagccccaggaaattagtacaactactaaaattttttgatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaagataaaatccaacatttgtttccattaccaccattgcactccagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacactgcaacagcctcctaattgctttcctcgcttctattgtggccagcctaggatttacgatccccagagcaatcagtataatattttgaggttaatgaggctgtgtgattccaagtccagtgttcccaaagcagaaaacaaacctaatcaacctcccttgcaaattggtggtccttctcctcttcagggatcccaaactctggcttcagaaatcgtatattttgttgctattgtatggaacaaacccttaaactggacaagcttttccgagtgataactcttggggaaaaaaaccatttaatggtattgggtagattttagggtatctcaactagaaagcgcagaaggttatcggtgttaactcctggttatcaaaatcgaacttccatctacctccttaaggaattttcacatgagtggtggtgtaggcacgtgtttgtgaaccaatgatataaaaacctcaggtttctcgataccatatataaaagttgagctattcccttttaagtacacatctgagagcatacaatgcatttaatctctaccttcattttaccactgaagagcggacccaacctttgttcatatacacaatttgatcttacataaacttatcaaaattaacactgcgtttctcaacaggaaacaatctcctgggcacatattcacgggtacgtaaccaggccaaagacagttcaagagcagcc

SEQ ID NO: 268 - DNA, 443455 bp, Homo sapiens
  misc_feature (81440)..(131439): n is a, c, g, or t
aaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcatcattcttgtacacttctcattggccactggtgtatttctatagggtggaggcctggagagcagttgttccagcatagtgtttacatagcttttatttaattccgttttctttcctttgttgctttattagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttgatcgccaacgtagatcggaactcggttcaccagcgacctgaggacccggcccagaagagggagtgtctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtacgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaatggtacctggttttggccatgctttgagcctttattcattctgttaacttgagacggtatataagcctctgcatcccattgtgtgtttcactcacgtccatgtgaagagaccaccaaacaggctttgtttgagcaacaaggctgtttatttcacctgggtgcaggcgggctgagtctgaaaagagtcagggaagggaaataggggtggggccattttataggatttaggtagataaaggaaaattacagtcaaagggggctcttctatggcgggcagggatgggttcacaaggtgctcagtgggggagctttctgagccaggatgagccaggagaaggaatttcacaaggcaatgtcatcagttaaggcaaggaccagccattttcacttcttttgttgtggaatgtcatcagaacaggccatttaaatttcacttcttttgtgattcttcagttatttcaggccatcttgatgtctacttgcaggtcacaggggatataatggcttagcttggtctcagaggcttgacattcctgtcttcttatattaataagaaaaataaaacaaaatagtgttgaagtgttggggcgatgaaaatttttggggatggtatggagtgataatggacgatgtttctcagggccactttgagcgggattaggggaggtgtgggaacctagagcgggagaggttaagctgaaggaagattttgtggtaaggggtgatattgtggggttgttagaaggagtatttgtcatatagaattattggtgatggcctggatacggttttgtatgaattgaaaaaagaacggaataagacaaggagaaaaacaggtattaaaggactaagaattgggaggacccaggacatccaattagagagtgcccaagggggttcagcatagccctgccatcaaagattatttatttactttaagagggagttaagagtggcaaatctggggacagcaccaggagatataagctgtgatggcttggagaaacagagtaaaccgccagtttaaacaagagcagagcatttatgagtagttgagaacggtgaatagaagtatgactagacagaagatagtagtgatgacaagtttttgggggcacagtccaagttggtctggtgtctggaatgagactggggcctaataaaaaggaacatctatacaggagcttaaatgggctgtaccctgtagcattctgaggacaggcccgaattctgagaaggcaagtggtaaaagtattgtccagtcctttttaagttggtggctgagcttggtgaggtgtgtttttaaaagaccattagtccgttttacctttcctaaagattgaggaccgtaagggatatgaaggtttcactgaataccaagagcctgagaaactgctcgggtgatttgactaataaaggccggtccgctatcgcactgtatagaggtgggaaggctaaactgatgaatgatgtctgacaaaagggaagaaatgaccgtggtggccttctctgaccctgtgggaaaagcctttacccatccagtgaaagtgtctacccagaccaagaggtattttagtttcctgtctcgaggcatatgagtaaagtcaatttgccagtcctgggcgggggcaaatcccctagcttgatgtgtaggaaagggaggggcctgagcaatccctgaggggtagtagaatagcagatggaacactgagaagtgtttccttgaggatagatttccacgatggaaaggaaatgagaggttctaagaaacgggctagcagcttgtaacttactgtaggaacacaagatgactgctttgggggtagtgttgggtagctgctattgtgctaagggctgaaattgactgaaattacctacaatttaccaactgggccttcctccagaagttgcaagccatcagtaggctccagagctctgaaatatttacatcagacagatcctgcctgtgcagttgttgtctagattccaggtgcttctcattccaccatcttcccaggatacactctgagcttctggattttgaattcagtcaagctgttctgtaacagctggggtgaaagccagcaatgatcctgctaagaaagctccctggaaaaaaaaagttcaaaagtaacataaatatcaaactggaaagaaattgatttaggaaccaaacccaggttgtcatggtgaaaaaaggggcagaaccttagctactgaactgcagcctggggtacgaggtgacaaccattgcttttttagtttggtttggctagcaaaggtggccttgttatataaataaagcccctctggtagtcaaaacctttattttctctctctctcttttttttttttttttttttttttgagaaggagtcttgctctgctgtccaggctggaatgcagtggtgtgatcagggctcactgcaagctccacctcctgggttcacaccattcttctgcctcagcctcctgagtaaatgggactacaggtgccagccaccatgcccagctaatttttttgtatttttagtacagatgtatttttagtagagtttcactgtgtttgtcaagatggtctcaatttcgtgacatcatgatccgcctgccttggcctcccaaagtgctgggattacaggcgtgagccaccgtgcccaatgaaaacctttattttcgtgatggctgcttatttatttatttatttatttatttatttatttatttatttattaatttttctttccctgctctccctctttttaaatttttattatttatttatttatttttctgcagagatttatccaattcagaggtcttgtccccataatttggaacattcctttggatttgatcaagtcagatagaactggtcaaacccaatggggaaaagaaggaaacaacaataaaaacaaacagaaaacaaaaaacagttcagaaaattaatgatcgcacaatttatatgattgcttagcactctaacggtaagaagaaattatgatcagttggttgttaatcttttttatttttttattttttattttttttgagacagagtctcgctctgtcgcccaggctggagtgcagtggcgcgatctcggctcactgcaagctccacctcccgggttcacgccattctcttgcctcagactggttgttaatcataactttaatcatttaggagaatttcaagacaaaacacaggttcagttacttacctaggaatagggcccaggctgaagactgctctgtaccatcctagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaaccttagatctcgatcaaattttgggaaatcagggattctctggagggggtggatctctgaggcctcagcaaattttcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaagtatagcagccaggtgcaaattgtgggggcctggaaataattttggtataacacagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccactcgctgtttagccctgatttgcatatgagactttgtgctagtcatctggtaacttttcactcagcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactttgaggtgggtgaagattagagcctggattaatcaagggcctgtggcttctaacaccatcagttgcctgtactcagccaccttcagcagtgctatctggctctagagagccatagcattccaggaaaggaaagaagtctgcacaaagccctgatgtttgtgtccccccatctagacagacatagtagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcatcaatgaagagtttcttcctcattgaatcactaacacgttttggatctctctgacttcctagtttgctgacctctgacctctagatccagactttaaaggcccatgttattagattagtcaacctttataatctccccattttaaggttaattgtatctgcaaaatccctttgccatacaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgtattatctgagttcctttctcaggaaaccaagcgttgggccctccagatagtatcaaagaactgaaatttaccagagtaccacatctggacaatgaaatgtcagaccccttatcccatcaaaattgcctaagtgaccacctgcttcctgttgaccaattcctctttcttacctctccctaattcctgttttcctgtatgtagttccatttcttccctgctatctaaaccctgaattttcattggtcaggaagatggatttgagactgatctcccatctcctaagttgtagtacctgatgaaagccttctttcctagcaaagctagttgactcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagagtacaattataaatacacatgcatctaatagagcctcaaaacacaggaagcaaaaagtgacagaattgaagggagaaatagacaatttaacaatagtagatggagactttaataccacaactttcaatagtggatacagcaactacacagaagatcaataaagaaataaaagatttaaacaacataacctaccagacatctatagaatactccactcaacaaaaacagaatacacttcctctcaagtacacacaggatgttctatagaatagaccatatgctagcctttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccacagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctataattccaatgttttgggaggccaaagtgtgagaataacttgggcccaggagtttgagacccacctgggcaacatagtgagaccccatctacacaaacacacacacaaaaaaacacacacacacacacaatagctgagtgtgatgacatgtgcctacagtcccggctattcaggaggctgaggcaggaggatcacttaagcctcggagtttgaggctgcagtgagctgtgatcatgtcattgcactccaggttgagcagcagagctagaccctttctattaaaaaaaagcaaaaaaaaaaccaaaaaactaacatgcttccccagtgggggaaatatgtcagtataacattggtttgcagcaagaagtatattaagatattgaccaaaatccttttattatttattttgtttttattttttgagacagggtctcactttgtcatccagaatggagtgccgtggcatgatcttggttcactacagcaaaaaacacctggacccaagcttgcagtgagcaatcatgtctcactgcaagctctgcctcctgggttcacaccattatcctgcctcagcctcccaagtagctgagactacaggcacctgccaccacacccggctaatgttttgtatttttagtagagacgaggtttcaccgtgttagccaggatggtctcgatctcctgacctcatgatctgcctgccttagcctcccaaagtgctgggattacaggcatgagccaccgtgcctagccccatgcctggctaattttttaaatttttttgtagaggcagggtttcgtcgtgctgcccaggttggtctcaaactcctgagctcaagtgatccaacaaccctggtctcccaaagtggtgggattacaggtgtgaaccactgcacctggcctctaaatcgatataagtcaattattcacacactgagaggaatattcaggatttttttcttataatataaatgatgtggaaatctggagaaccaaagaagaacaccaagactatctaaaagtgttaaatttttcattaggaagaaaatgaattcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgctgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttagatacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacatactataaaatttacccattataattgtacagttgaataatttttagtaatttacccaagtagtgcaaccattaccataatccatgcatttgtttttaatttattatttgtctgggttctgattctacttccaccacaagcttcagcatggcagtatctgccaccacttgttttggtccaagggcagaaatgagcatcctggaaaccaatcagtacttgcgctctgaactggaaaagtgcaaacagaacttccaagacctcacagagaaattcctgacatccaaagctactgcctactgcctggccaatcacctgcagaaatgtagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggtgagtgtagtgaggaatagagactaaaaccttggtttaggcatgaaactgtctttcccctctcagcaatgaatatcagattccacaaacatgtaacatcactgttggttaaaacatctcaggattcgatttaaacttttttaagagcgcccatttgcaaagcactgtgccaacagcatcaggggtgatagaagtaatagtataccctatctgccttgaaggaacttaaaactagctattctcaactgagtcacagatatgtggagatgtgaacttcaatagcagacatggaaaaaagtctttatgatacctggatcaagattctcttcccacaaaagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacctgttactaatagtcagggaagggaagctgtaatgacaaggaaacatgggaacaagggcatgagaggaacagggatattagaagaggattctggttaacatagaaattgagtttgttttccaatttctacaattattttaaaatacatcattgtgtggggggtggctaaaagttgctgtctaacttactgtcatagaaaagtaaaaccaaaagcccacttattaaagaagtgaaaagatgagctttggtgtgtggaaaaactagtttaaaaaaaaaaccttcactcattataattgtaggaaaaaaatttctcaagctagagaagaagaaagatattacctaagaccctagtataaaggtattattgtgcagtgattaaaaagcatataccctggggccaaatttcctgggttcaaatctaacttatcatcactgtgcctcagttttctcatctgtaatggtaatagagtaggaactacctctttggatggtggtgatgatcatatgatgataattcttaaaaacctactgcaacagtaccatgacaaacactatgtgttggttctccctttaaaacaccacctattagcttttgggcacatatcatttggatctttctcctctatatacagttttacacagctgtatacagataaatgtttaaatctttgaaatattttgggattattgaaactcctgacacaggaggaccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtatggtggggcacacttgtaatctcagctacttgggaggctgaggcaggagaataacccgggagtcagaggtgcagtgagccgagattgtgccactgccctccagcctgggcaaaaaagtgagattccatctcaaaaaaaaaaaaaaaaagaaaagaaaaacatgtggcgtcagacctcaggggatgtgaattctgactgcctcattccagctgaatcatcttgtcaagtgactttatcaggcttttctttcctcatctctaaaacagggagtagttgagagactgaggaatacagatatggaaatcccagcgtaaagcctcgtactggggatacttttatccttgagatagaccctgcctcctgccctgcaggcagtgaccacagcagcatggccagccttccatgatgcaggcatgtctatcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagtagggcagctcaggctggtagaacaaagagcaaatttgtgcaaggagaagggcagaaatgtatgactcaggcacagaactagactaagacacaatgaggttatggtctagttaggtctctagggttttccattaaatagcatattagtaaaatggagacagctgtctgcattggaatactagcaatgtggcttctatttgtgtgtccttggtcaaatttacttcacttttctgcgtgtcattaaactaggctacctcatttataaaatgcaaatactgacagtatctacttagagggttatgaagattaaatgcacaattgcaagtagttagaaccatctctaacacatataaaactctgaacaactattttctgtaattattatatttgtccccatttatagatgtggtgattgtcattaatattttctataagagatattttcaaactttccaaagtgcctttcatgataacaatgtttctcctccaaactttttaaaaaagtattatactaggtggagtattaactggtagggctgttgggtagatagatgattgagcagctgttgtgtggaaaatgaattattaattcgctcaggaccagcattgactatccttagagggtttcagacataaggtagattgtcgcattcgaaacttcttttaatcctttgttgaaatgaaatcatagaagctcaaatttgtaaaactcaccaaagcagagatatttgattgaaggtgggataggtctggagcccctgtttctccccagtatgtgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgggtacatactaccgggtgctgtaagttgggtaataggtagcactatctttagactcacagagctcacactctacattggaacccatgtgtattagtccactctgacactgctataaacatatatctgagattggtgatttataaagaaaagaggtttaattggctcatggttctgtgggctgtacaggcttctgcttctgggcaggcctcagaaaacttacaatcattgcagaagtcaaaggggaagaaggcatggtcttcacatggccagagcaggagagagagagagagcaaagagggaggtgcacactttcaaacgaccagacctcatgagaactcactcactatcatgagaacagcaagggggaaatccaccaccatgatccagtcactatccagcaggtccctggttggattacaatccgacatgagatttgagtggggacacagagccaaaccatatcaccatgagaaatatttaaacaataattagaaaaaaaataaatccgcacagagtaatgaaattactactcagaactttactttttttctttttttgagatggagtcttaccctgttgcccaggctagagtgcagtggtgtgatctcagctcactgcaacctcaacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcatgagccactgtgcccggccagaactttagttttaactgccttcttactgattatagtctatcttcatgtcattcagaagaatactgcccctcttgaccttttcactgatttttctttttaactttcaattaatactagagataccggcccaacagttttgaacttggcttttttttttttttttctgccagttactgcatatgaaaaggtacatgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacactgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggagtcagaggcggaggttgcagtgaaccgagatcacatcactgcactccagcttgggcaacagagtgagaccctgtctcaaaaaaaaagaaaaaaagaattcaacttgggagttccttacagggattctaagagatctctcctctgaaacttctataacctattattcactacattccctcatacattttactcttctttcccaccttaggatacatgatcccttaattcaggctcaggctgaagaactgacccacttacaacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgccccaaagtggggagaaaaaatgcaaacttatctccattatagattttattttagttttgactatggtccttaatctgcattctattgttttctctttagagcactcaggtaatcacttttcatattctttctagaattctaagttttgttttttattttgagacagagtcttgctctcttacccaagctggagtgcagtgacatgatcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggctggtcttgaactactgagctgaagtaatccacctgctttggcctcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccactgtcttctggcttacactgttccaacaagaagtctgccataattcttatttctgtttctctgtacataatatgtcttttttctctggatgcttttgagattttctatttatcactcgtttgaagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaatttaatttatgtctttttttaagttcttctatgtaactcttcatcatttcatattttcctctagcttctttattttattttattctattttttgagacagagtctcgctctgttgcccaggctgaagtgcagtggtgagattttggctcactgcaacattcacctcctaagttcaagtgattcctgtgcctcagcctcctgagtagctggaattaccggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctctccaagctggctttttaatttttttcaggcagcataagagcagctattagtcaactgctattttttttcccactatggaggcaaaatgacctttaagaaaatagaccttattttttagagtagtttcagattcacagcaaaattgagcaggaagtacagaaagttcccatataccccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcacgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccgatgctaatctaatgccatcgttgatctgacaggaggctgagctcaggcggtaatgctttctcgctggctgctcacctcctgctgtgcggtcccattcctaacaggccatggaccagtgctgggggttggggactcctgttctaaccaatgctccctctattaaaagggattttcacactagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgtcttcttcaaagttactaccaggctctgcctgggtcctccctccctgctctacagttgacaatctcaggcagcaaactggagcaatcatagggctcacctcttttatttattatagtactgcactgtatccaatgttgaagatagagtttaaaatactttttccagtttctcagttgtttaaggtggaggacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaagaattacccccaacaacatctgaggaagcacaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcagccaggcaagtattctttgagctggggaacaaaaggcatttaaaactttttgctctgcttcaggcagctgacgtctggtgatgattcaccatatcaggaacaccctgtccagtgggctaaggcaagcctgccaggccacttctctaaagacacaacctgaggcctcctgcaataattctcacagagcattctgaacatacatgtaagctgttatgtccctgatcatatagggcccatgtgtgcaatgtgtgaaatgggacctgcttaatttctgactagctctttctaattttggtttgcagaaaatcacaatggtaagaaaaatgaagacaggcaaaagccactggctcccaggtaactctacatgatgaaggggctgataatggactgaccaaatctagagagaattccagaagcaaggactcaagaggttgaaggtcccagatctagaaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcattttacaaggtcaggagttcaagaccagcttggccaacataatgaaacctcatctttactaaaaatacacacacacaaaaaaaaaattagccaagcatggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaggttacgtttcatttccatatcattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatggtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttacagtctattggatattatggtgaagggcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttgaatcaacttcattcatcatggaagaatgttccattcataaacagattaaagagtaccttagatccatagaaggtgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgatcatgcgcttactctgagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcatatgcaaaagggctatgagtaggaggaaaactcaggcctctgaggtctcctgaaagagttttgctaatgtcacaactggctttctatgttatctgaagattgagatctccatgaagagtgaagataggtaatgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatacttgcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcatctagaggggtcttactggaagccttttactcagtccctttaatttccttgggtgtatactacggttccactgacatggatgacctggtagtagcgcagcagcctgaaataccagggtttccttagctgtggccttagctgctctttccaaaagggaatttcctctaataagaacagtgtcttccttctggtgtcccctgcagtgaatacttgttatttctttgggaattggacggcatctaaaagttccaagatctgagtaaagttgtatgggggatcccttggctcttgatagtcccctttccttccctatggttgcatgagcctgaagcacccggaaaccatacttagagtcagtaaacacattgactcttgagggtttttttttcttttttgaaacggagtcttcctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgtaataatccatacttcattatcaggggatggatgccccttggagccaaaggtctaaaaggatactggatttttctttttttttttttttttgagtcagagtcttgctctgttatccaggctggagtgcggcggcgcaaggctcactgctacctctgccttccgggttcaagcaattctcctgccacagccttctgagtagttgggattgcagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatattttttttcccatagataattaacactgggtttcaaaataacctggactgggagaacatttgcagttcttccaggaactaccatgtcacaagcagacgggtctacttgagaagtaatatttgatggaaggaacgtcttttctttatctgtgttaagacatgaacttagagctaggagaagtgtcccttcccagcctgtggccttctcttgaggtgctccaaattgaactgcagcctgttattgggaaagtaagtctcttcccagtaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggccccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccgagaagctcagactccgtttggagactgaggcagtctttcctccagtggccctcttgcttacagaaggcacactgattccagcctaggggatgatgagctggcttttgtctgggcatcccaaagccactcttgcaacactttctcaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagagcccgcccttccgggttgtctgggtctacattagtatatttcctgagtgcctcaaccaagcagccctaaaacagaatgggattttcatccttccactgagttacttctctatccttgtcacaattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatacttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtgggggatacaggctggagctagctaaataaaagggagggttttctgatgacattggggtgaaatcccacactggagaactggcaggacccctcgcagaactgggggactgagaagaccctggagagggcatgggccctccagggggtgccgctaggaagggagcatcgaggatatcccacgcggtttcttggtgcctggaagtaacatgagccagacacatcctgcagttgactcttaagtcagaatcctggtagggggccatagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagaagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaaatatttgggcaaaatgtttgggtggctgctgcttgtctgccactatgggtagttgtcacttgggccaggggtccaggaacccctggtccctgtgaccaagagttcaatatgggcttgagcaaagtcacgtaggagggggcccacaactggctgttatggaaaattgtaatcttttaatttaagggcggagaagatgacatccacactcctccagggaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcactaccaagtgtcctgccttaaacagttcttgactctgtcctgtcctgtcctgtgttatatcatgtcctgtcccatcttgttttgtctttgtggtcaccagatgatgcaaggaaggacaaccccaaaattggggcttagcccaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggttattcagaactttttggaaaagggatgaggagtttccagaagcatataaggtaacttcctggccattgccatggcaagttgacatggcatttataaactgtcatggcactggtaggagtgtctttatgctaatgagcagtgagggcaactagaggtagcttttgtctccatctgctggttttggtcagcttctttactgcaccctgtttggaccagatcctgctctgatcaactgggccacaaccgcaaaataagtcctgccactttcctgcctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacatatcattagctggaagctgcctctatccatatattaaaggtttctccatatgtagtgaactgtaacctaactggatgtgtaaacaacctgtaacctactcttgagccaatgactgaggtttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtattatatattatatacacatgtaatatatatatgtatgtgtatatataatatttatttgagagagagagaagtgacttgtggtactgatgttgcttgcctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcatgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccaggaccatcaaaagcacacctgcactaggtcattgggaactttggaggtgccttacatctgggcatgcattgaaccaccacacaaggtgaaatgcctcttctcaaagaggcttgcctgcagtttccactaacgaaattgtgagtcatagctgttcttctgtttgagatattaggagggattttgtggggggtgaggggggatgaaagtgagtttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaagtggaaagattgactgagcccagcaatttgagaccagcctgggcaacatggcaagatccccatccctataaaaatttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagcgtttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcacgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaacaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggacaccccactggccaacgggaccctaggcaaaccttataaactgagtcccaggccaagaaggaacgggaggccagacaagcctcattatattcccacccttttgcaatttagacaaaactgaccaacattaatgttatcacagagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaagtttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcattatctgtgggagagttactctgaaagcagcaagaagccattaccagatgcagatctcattctgtcagtaatggcaacccagcaaataggacaggagccccacccaggttggatcaatgcatggctgtataaccttgagcaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcaccattaactccccttcttcaccagagttttctggcacccaagactacagaaactctcctgcagtgggctttggggcacatcgcaagttccagtaacaagggctaagatcgcccgcttttggagaccttacaaagcatgtattccctgaccaggaatcgaactcgagctgcaggcggtgaaagcgccgaatcctagccactagaccaccagggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttaaactctctattgaaaaatgaacaaatgttcagaacagaggaagtagagtggtggcaccatcaaaggcaggaagggccaagagaacctgatgggagtggggatatagacctggttctagcttccagtcttccagtcactaactttctgctgtgtgcagggcacaatggaagtaaacaccacccactatatatcccctgtgcctggcatacagaatcattcatacatgttgaccgaagggtttcctttgcttctaggggattatgtatcattttgggaggaagcatgtattctgtgaggttgtttagtttatgtccaagtgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtactctttatcatatgaggagagtgctaattaatgtgtcatttattttgtgagcatgctaataaatatattcatattccaatttagtgaaaaaaaattgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttctatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagctgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctctctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccatgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatatgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgattttttgctgtgagacaaacttgaaaagttcacagacactgcctttctctgaaaactgcccttacctctttgttacaattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcctgtgtccttcagtggtgatggctctgaaacccttgtgttttatgaacttcatgccctggtcttcaaacgaattcagtgcaggccaagaagcacagtttggcctgggttggatgctctatattttcaaacagtgaaatgccttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcaggtcaggcccttcagcctggtggaagagcaggcagggagggtcctatggttcctgggaggacccgaagcatgatcacctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgtggaaccgtaaatgagggttcagcctgtctgcctgagggattgtgtttcctggcgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacacgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaatcccaagaggtagatgttgcggtgagctgagattgtgccattgcactccagcctaggcaacaagagtgagactacgtcttaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagaagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaatatatatatatatatatatatatatatatatatatatatatataaaaattagctggacgtggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaccgcactgaggggaaaagtcaatgtgaaattctacaaaagctgaaaattcactaccaccagccattaccacaaaaaaaaaaaaaaaaaagttgaaggagtcctccaggcagaacgaaactgacatcggatgaaaatctggttgtccaaaaaaaaaaaaaaaaaaaaaaaaaaaactagacatgacatctaatagaagaatatataattttaacatctgactgtttagctgggcgtggtggctcacgcctgtaatcccagcactttgggaagctgaggcaggcagatcacttgaggtcaggtgtttgagaccagcttggccaatatggtgaacccctctctctactaaaaatacaaaaattagtaaggtgtggtggcccacgcctgtaatctctgctactcaggagtctgagtcaggagaatcgcttgaacccgggaagcagaggttgcagtgagccaagattgttccactgcactccagcctatatggaacctagtttgatctggagggatcttattttataggaggcttggagggggaccttttgctttgtgtactcataggatgcacaagacacaagggaacaatctctcactttttaaatacagtgataggcctgaggagaaacaactgcaaattttttttttttttaatgagatgggattctcactggtcttgaactgagctcaggcgaggcttcccctacgtcggcctctcaaagtgttgggattaataggcgcgagccaccgcgcctgaccacaactaaccaacatttaaaagcacgtccctgggtaggctcgaaccaccaactttccggttaacggccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttccacgttagaaacgcttgcattgcctgactctgaaaccagaagggcggccgaatggccttcaccctccgttaaccctcgcctgcttcagaagccagtgcctctggaaatgcctggatctgcgaccccagcctgagcctagtagggcccaagggaagctgaacgccccgacggctctcatggtagctctttctgtttttttgcgccgccttcaggcaatcatctactccgcttgctatcccctcactcaactcggcttcagtagatggggttggtggggcgggagcgggaaagaagcaggggagtcaaaagggaaaacctgaaaagaaggagggagaagcaggggagaccaggacaagacaatgggacagcccaggatgccggtgcagagggcaccggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggggaccgggagcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgtgtcttttggtttgcctttaattcctgcaccagctgcggcctttatctgcagccagaaagcaggttttaccgctggtcccacagcgccatacggtctggggaaaagaaggaaacccaatagtacacaaacaaaggccaaaagagaaaccttccaagtgctctatgccttacggtttagcagaaaatatcaaacaactctcaacctagctggtctgtagcttccacaaatgaaatactgtattcattgcagcctttctggttgagatatttcaaatatttggtggagcttttaatgagacggagagacactctcgagtgtggaagaaaaaaatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctacagggacagcacagcgtcctcgccctggccggacgctcagggtcaccaccctacccactgcccccctcgccattcttccaaaccactctctgccaaagattccaccgacagtcaccccacacgacaacccaggccgcctttcagcagcggctcccgccccgcaaccacgcgccctctcacccccgcggttctgcccgccgcctctatccagtctgtgcacttcacctccctggctcccgctctcccctgagcttacagtggacgcggggttcttccgaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacagctcagcccgataggcacctccggggcggcgacggcaaagagggtgcccttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctagctgcggaggctgttctacatctgacccttggagcaggccggctgacagcgtagtaaaggaagatttctgcgggagggcggccagtgcaaaacaattccctgaccgggaatcgaacccgggccgtgacgctttcagcaccgaatcctagccactagacaaccatgcagatgcggaaagctgctttctctcccttcttcgacctgaagcgacactttcctgtgctctaggaggacttgggtcttgtgagagtcgctctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgcgaggcggcagcaactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcaccaattcgtgatttccgtcggccaagtgcgtgggcattgatctacacgtgagtttctccacctctgccgaatggctacttcggggtgggggaagggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttttcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcagatgcgcggtgcgcggggaagaagaggatttgactgcggttctccacccccggcgcctaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatgtaaactgggtggctaattcacaacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaatgggactaaatccagactcagttattgcaatgtgtgcaaaagaacaaggacttgtactatctgacttcaaggcttactataagctattatagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctccgttcttctgtggttagaagacctgaacccaactccctccccaagcactggagatggggcttttccaagggctagggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagttttttttttcttcttcctttttttctctagctaaacaagcactggccttgagataagcaatgctgaagcacttgcagctcacctattaccaaaaactgactgagccctccctacacaagccataactactgctttgattggacaagagactgatttcagtagttttctcttggtaagagaccactggccgtgggctggttctggacagtttacagaagctatgcacttgattgcctttgtgtccctgcttcaccttttgaagcatagggcctaattataatgtatttaaatgttgtctccaccccaaagtgaacatgggttgcatgtaacaggcgtgtttactcagcatgcatgcagcaggatcccttcacaaatattcagagctccccctattccctgttgaatatgtatatgtggccaaccagatcaacgtaaatcactattcgccctcccctccctggaaacttacttttcgggtttcagcaggaagctatgcctcccagtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcaaataggcctttgcaaaggagaatttcttatatgctggaagccataaaaaaatatgcttcatagtattgctcattaggcaagtacaaattaattccacactgagataccactaaccaatcaccagtgtgtggctacttttttttttttttctgagacagggtctctctcacccaagctggagtgcaatggtgcgattggtgcgatcttgagtcactgcaacctccccctcctgagtagctgggactacaggtgcatgccaccatgcctggctaatttttgtattttcagtagagacggggtttcgccatgttggccagtttggtctgagagcatagctacattttaaaaagttagcacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccagtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtggactaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctacaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcctggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccctccgggagcttcatttcttgttcctctccgtagtggctcagcggtaagcccaaggtccagcacacgaatcaggaaactgatggttcttgggttagcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatatcttttgctgctactttggtcagcgttgttgtcagtttaccttgtggtggccaagcccttaaatgcactattaggttatgcagtgtaattctgcagggcagaagggtaaagagccatagtgaagagcaaaaatacctcttatcttgaccgggaattaaacccgggtctcccgcgtgggaggcgagaattctaccactgaaccaccagtgcctctctctagcaaccctgggagaattatcaaaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcagtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagtagagagatttcttttctcaattttccctggagagattaaactgaagagaaaaattcagagagtttgccccacatgttgggtctgcgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctatatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaatagcgtttaagtttattggatactccacaagcttactgccactttattaccacacttttccatctatcggctcttgcatccattaacataagcagacaaaaaactggactcctggccgggtgcggtggctcaagcctgtaaccccagcactttgggaggccaaggcaggcggatcacgaagtcagaagattgagaccatcctgactaacatggtgaaaccccatctctactaaaactacaaaaaaaaaaaaaaaaattagccaggcgtggtggcacccatctgtagtcccagctactcgggaggctgaagcaggagaatcgcttgaacccaggaggcagaggttgcaatgagccaagaccacacaactgcactccagcctgggtgaaaaagcaagactccacctcaaaaaaaaacaaaacaaaaacaaacaaaaaaaaaactggactccctacagccagtgtagtatgcaccactcacttgccacactgtatgctgagtgacccttccacagcttaaatctgcacataacttcagcctagagccatataatgtccctttatttcttcagtacaatgattaataccatattctctgtacccttcttccctctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagctgattcacctccttggtgagggctctctccctggcttgcagactgctacattctccttctgtcttcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccatcctctgcagtcatcctgtcagtttccattccattctcctatccctggcttgctggttcaatactcttaagtgatttactgctggtgctcttctttttccctcagagataccttgtgatttctttgattctctccacctctacaggttaataagtctaatatttaaaaactctgtagaaggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaaacgcactgccgagaggccagaaggcaaagcgagagtcggtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagagctaacaaaaaaaaaaaaaaaacttatgtttccgcccggtttcgaaccggggacctttacgcgtgtgaggcgaacgtgataaccactacactacggaaaccacaggcggaacctgcacggcaaaatataaccatgaaaatcttagatcagccgtttctattatagtttccaaatccgagatcgcaccactgcactccagcctagacgacagagcgagagtctcaaaaaaaagttgggagaagaaggtgccattttccctagttgcttttcttactgcggtggtgaccgcattgccttcacacctgaagtccaagtgcttccaccctgcagaatatgcagaccgctgggtcactggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccaaaggaaaagcgcaaaggcggcccaaccccacgacctgagcaagccaagggtcgcgggttaaattgcgtttatcagaacagttgtttgctcactgtcccaaagccctcctagggacaaagaaaacactggcatggcaccaatcgcagaagggggcagcattgacacccaggaacaggagtggaaaagcaggaaaagcagggatcatctctctcctaccccgtatatggctgcagacatagcagtggttcttttctccaggacccagtgagtgtgcaccaggagagaaaattatgcacgttattcatggtggcaccacccaggctgaaagtgagcctgtgctgcttgggctttcaggaaggacggacccaactctccctccctatacagagctgcagtgccctggcaatggaggacagaccatggagttgcctgccctggactcggggaagaggctctgccctaaaccccattttagtggtagctgtcagagtggcatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactgaactgcatcctaaactggaccactgaattcaaaaaccctgctaccaaagggcttagtgctagtccatgagataagtttcctgagaattccgtaccctcagcccccaacaagggttagtgtgttagcttttacttccaacacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaaaattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgttggaaatgacagataagaattccaaatacggattgcaagggaactcaatgagatccaagaaaaagttgaagtccaatgcaaagaaatcagaaaaacaatacagaatatgaaagacaagaaaactatattaagcaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccattgaaaagcatacagtcatcagacttcccaagataaatgtgaaagaaaaaatcttaaaggcagctgaagaaaagggccagattatctataaaggaaatcccatcagactaacagcaaacttttcaacggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatataaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaggcatagggtggcaaattgggaaaaaaaaaaaaatcaaactttccatggcctttaagagagacctatcttacatgttatagcccccagaggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttaaattggactcttgactaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaaattgaaacaaatgaaagtagagacacaatgtgccaaaaactctggaatatagaaaaacagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcgagcagaactaaatgaaacagagataaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttgaattcctggaagcacacagcttcttaagattgaaccaggaagaaattgaaatcctgaacagaccaataatgagttatgtaattgaatcagtaataaaaattctactaatctgaaagagccctggaccagacagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaattctcaacaaaatactagcaaactgaatccagcagcacatcaaaaagataattcatcatgatcatgtgggctttattcctaggatgcaaggatggttcaacagacgcaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcaggttacaacatgagcatacaaaaatcagtagcatttctatacactaaaaatgctcaagctgacagccaagtcaagaacttaatcccatttaaaatagccacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcacacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagctgagatcatgccactacactctagcctgggtgacagagtgagaccctgtctcaaaaaaaaaaaagaaaaaatccccatggaaccaaaaaacagcccgaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaactaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcttatgactaagacctcaaaagcaaatgcaacaaaaatgaaaattgacaaatgggacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaattctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcgccacagccagaagagtgactctgagtatatgaatgaggggctacagtggactgtccagtacctagggagggagagacagggctgcaatgaagtctggagggatttaggaaattcattgattgtaccaaacaaaaacttacatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacacgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttccttctggaagcctgaaaactccagtttgcttccctgagcccttttcctgttgcacaactagggtgtggactacaggtcctacccatggaagatggaggtagatacttcacagggaataaaaacaacctagacaagtcatacctttaggtaacagatactttcaaagatgtactttcctgcacccattaaagttttagtctcagctaatctgaaaacctgcggtcctcatgcactgggatagcagtgcaatatggctcaggctcaggttttgctgggcacaccagagtaggccacacactctcatgtgcagtggcttcaggtatggatcagggtctttcccactaattggcttcagttatgatgttgtaggtcatcattcttctggctttaatatgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctccagcctctccctcaggcggtcattgagactgatggactcctccaggcgctggcgcaggttctgcatctcagcaagattcttttccagcaggtcggcccctactgcaaaccaccaagacataggagaggtaggaggtagggaagcctgatcatccctgggcagctgtggggcctgcctggcaactctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagagggggaacaggagagaagggaacaatctccaaggaaggaaaaagatgcacagagagaggaggctgagaataggcctcacccactgggagattttgcgtagggtcaggtttttctctgagaatttaaaatgtcttattgttacactacctgggacacagaaatggagctgcttcaagccattcctctaaatacctgcactcctagctgccaggtgccaggatgtttggctccaaatccaaaagcaatgtttatgggggcaggattggcacgtggttgtatgcacagtgtgtgtgaaagatgtgtgtgaaagagtggaaagagtgtgtaggggtgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtaagttcctaggtagggtggctaggagaaggcactttcaaagaacaagcactgagctggttctcactgtctggctgatctacatattgtcctgtcattttttatgaaccaggttctaacagaggaaccaaaaagtcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaatgagtgttttaaaggtaattatagtgagttgaatagtgtcctccaaaaattcattcagttcacttggaacttcagaatgtgatcttatttgtaaatgggttttttgtagatataataagttaagatgagatgatagtgaattgggggtatgtcttaaatccaacatgactgatgtccttatgagaggagaggagacacagagataaagagacatacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttaggcgtcttcatctccagaactgtgagagaatacatttctgttttaagatgcccagtttgtgtttttttgttttggaagccctcgaaagctaataaagcaatccacggaatgaagactaaggcagatgtcagcagactcatttcccaaggactccccatttcaccctaaagtaactggcatttctcagcctatgacataagcagtagtgttagttgtaatatctgagcatcacagcgcacatacaggaaaaatatggggcccctctcctagcttcctttatgattcccaatgctggaatgaacctggggaggtacttcagaaatgtttctcctaatagcaggactcacagccaatcctaggagttcagacagtgaggggtgaagcattttgttggtctgtaaacaggtgactatttattcaacattctatgcccttgccagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccacagaatagctagtgtactcttgcatagaggattgtagaatcacaaaatacatggcatcttacagctcaatgatgccatgagaacatggccagatcctctgggcccttcattactgtctccctttgagagaaaaacccagctggggtggcagggccataattcagagaaaagttttagagtctttccctttcaaggattattatcaagggctaaagaatagacaagtttctcctctgagcaggtgggagtgaggtttctgtttgccctcaacaacatcacgttcttttaggaactgtatatttaaatcagtaaccagtaggtctctccttctccaatttataaaatatcagatactaattagaatcactgtgagataaagagtaatgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacattctctggccataccacacggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaaccgttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttcagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaatccattatgggccgggcatggtggctcatgcctgtaagcccagcactttgggaagctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactctgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcctcttcccgtctctatcaaggctatcccaaggaccctctcagggaaattctcaggagggacacgctggttggtgatagactcagcttgaacctcacagcatggccccattcactgatggtttagagggtgttacagcaaacttattaggatgatggatgggatctgtaaatgcataaatgataaagatgatttagtgatgaacaaaaaataggaactgttgctgtttaccccagggattccaggattaggtgcacaatgttagcaacactcatgtccctagtttgaaagatgacataattgtgtgcagtgaagaggaactatttgccccctttctccccttcccaacccatgccccccaagaccaagaccatgtatgtgccagaggagatctagtgactgatggcatgtgagactgggaacggagaaaagctacctgaaaaccttggggcttatgctcagcactgagtcctggagctgtgcccgaccaggtacatcacggtggatctacagggcccggctgcaaagatgccacctcttggcctagacaatgcatgagcccccaaaaactggagccatgtggctactcactgactacagtcactgaaggatgcacttcctccttgtcaagctgtggagacgtgctgctcagggagtgatgtggggtagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctgagggctcacaggagatgtaaaggggaggtcaagaggatcattccttcagaggagaagccaaacaaatcatttctgtttcaggatagagtatggagggaaggcggggacagagagagcaacagttgtccggtgcattggctacaaacatcctgaggaaaaacgaagccgtaatgggccccttaaataacactcatgattccttcacaaaacacccagagacccataagagttcaactccaggtatgggcatggcggtacatgcctgtaatcccagcaatttgggagaccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcatgccactgcattccagcctgggcaacagagcaagacctcatctcaaaaataaaattttaaaaatgtaaaaaaaaaaaaagaattcaactcattctgtgaacataatttttaaaatagtatttgccataggccatttaaaacagattccccaggcaatgtagcctcactggtgtcttgcagtttctagatctccttccctaagtatagagacacagtataaacttttgtttgcaagaaaaatttgtagccgttttacatcttccagcgctccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatcactaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggaccagagacttgactacctgatgcttgccttgattccaggatactctgaattttctcagatcttgggttgagtctttagagagcttgtctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgttccttctgtctttctgccaattagtttcagaggaataccatcatccctggggatgcctcctgccctaacagtcatattccatgagggatggaggtgctggtgatcatcatggcatcctcaacccttcttcttggagctcctctccagccagtcctgactctgtcatggtcttaaggtggtgattacaaagcaggacaccaggttgaaaagtgacatgtgaatgggggtggcatcctgtgaacttaggaccttgggagagactgaaaatcttcctaagctctgcggccaacttacctgtgctgaattttctggcaaggctctctgccagctggcttcctttggccagctgctcgcagtagtgctgctccatatagtggtcaaagttattgctctggagtagctcctcaaaggtctttagtgtgttcttgacatgctggatgagaagagcagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaatctctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttatctatgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaggccgggcgcggtggctcatgcccgtaactccagcacttagggaggtcgaggtgggcggatcatgaggtcaggagatcgagaccatcctggctaacacggcgaaaccccgtctctactgaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagaggtcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaatagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatgtttgacaaagggacaagggcaatacaatggagaaaagatagtattttcaaaaaatggtgctggaacagcgggacatccacatgcaaagaaagtgaatctagacacagacttcacattcttcatgaaaacttactcaaaatggatcataggcctaaatgtaaaacataaaatgataaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttacttgttggagggcatgatcatggctcactgaagcattccttgggcatgatcatggtgtgattatggctcactgcagccaaactcttgggctcaagtgatcctcttgcctcagccttccaaagtgctgggattacaggtgtgagccaccgagcccagctatatgattatttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagatatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagtttacacaaaaacctgcacatgatgtttatagcagctctattcataactgcaaaaacttggaagcaaccaagatgtccttcagtaggtgaatggataaattttgatacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagagagtaaaaagatcagtggttgccaggtgttaggaggaaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtgggttcatcagttgtaccaaatgttatcactcgggggcaagatgttgatagtgagggaggctgtgtccttgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattctaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgttttgtctgagatggaatcttgctctgtcatccaggctgaagtgcagtggcgctatctcggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgtgcctggcctagcgttattttagccctaactaacattattctctgggtcagtgaaatttaagtggaatatattgggcagtgacctaatggagcatgaagcaggatttgaatcacttccaaagctgtacaccaaccacttaggcaaagtagtgatttcagtaacttagtatttcagtaactggtgctcacaggcaaatgcgtaatggattaaccccatattatttaaatgcttccaaaaagctataggaaaatggccattaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacgtatgaagaaacaggagattcctacatgctcctggggatccagaagagagaccactcacatgactggaagatttccagctcaggtaaccacaaaggccatatatttggtgaatacaggcaatgttagttagaataaaaccaaatttctctgaataatataaagtcattactaataaaacttttatagatttttctctgaagaaatttccaggaaggtgttaagagaaagccctacaattaaggtatggaggctggctgcaggccctgaaagctgctctgatgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcagggtgggtgctgttatgagaaggaaggggaggtcccacaggtgtttagaagaaaaagcaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttgagatgccagagctcaaatcccatgtcactgggacatcaacaatagtgctatggggaagactcagggtgccagctcttgagtcacaatcacagaattagaatgtggaagtagctacagaacccaaggaagccctgccttctgatagctacactcaatgcaaggctgcgtatttcaccctggaggtctctaacaggggaggccaccccctcaatagccagcttttttacccttttgcttacgttgtcaaccaatttctaaccacagcaaaataacctaagtatacctctccttgaaaacatcaaaacattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtattactttttaatacataataaataatatatcccaatgcgatacttgcttcctttcccttgcagtagcaacgtgtaggggtttcatttaatatgaggtcgatttgagccttccaaactcccattccacccacctttgcttgcactcatgggaaggctcagtctatatctggtttgcccacattcctaggctacagacctctaggactcccagtttgagaggcgccatttttttggagggtagtgaattttgatttctgtctcctttgcatccttcccagtgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacacgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaagagaagaggccattggtagtatatacttgcatttttcttgtaatacttgcataagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattgtagggaatgttaaaatttctcactggtacagttagaaatgaaaacaaagacaataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatctattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggatatatactcaaaagaactgaaagcaaggattcaaagagatatttgtgcacctgcatcaatagcagtattacaataactaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggacattatgcaaagtgaaataaaccagtcacaaaaggaaaaatactatataattctgcttatatgaagtacctagagtagtcaaagtcatagagacaggaaataatggtggttgtgccaggggctagggagggaagaatgggaaattaatgggtatagggtttaggaactttagtctaagaaaggagaatattggatgccagaaattcagttttctttctgttccaagatccctttagctagagcgacatattgaagtcagagttcctaagggaaaatcattgtgtatggagatcatccttgtggatcaaatgtgaatcaatagtagatcaaaagatattccacttttgcagatattgacatttgttggacccgtaagattttatctagtattagatagataagatgtgaaccacttctcaacgctgcagactcaaatactaggaaatactaagaacctcaggacaaacaaatagccagtccaaaaagactcacagactagataagctgtcatctaccacctaacagataatgtatccctgttaaccactatctccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataaggtgcaggattctattagctaagattatgtctcaggtgggcaaatctctgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagtctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatacaaaatatcttggaagtttagctgaagagatgaggagatactctactgctcaatgtgcgccatgtcatctgttgtacctccccttagttaagtcaggagggcaacactccctttattttttattttattttgtatgtatgtgtgtgtgagatggagtctcactctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcggcccctctatttatcagacagatgtatagaaagtttattgtgctagcaagagtatgaagaaaaggattctctgagttgaaaaaacaaattggaatataaattggtaccacttctatggaaggcaaatttacagggcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgatcgagcaattagtaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactacatttctttccaacagagaccttcttggaggatgagaagcagccactagttgacaggaggggaagtgaggcatgtagtcttcaagggagcagaccaccgtgggagttataaaagaccagcgacgcctctgggtgggttcgaaccaccaaccttttagttaacagccaaacgcgctagccgattgcgccacagagacatggctgagctcctaatttcgttctataagagggtaagctgtcactaaacgctagctagcaccatccgccttttgcaaaatgactgggtaatctccaaagcctcggaaagccggagcagtcagagcgacgaatctacttgtttgtcaagtttgaaacctgtgcattgagtgattccgaaacgccccgcaccccgccttgcctgcctcagaagccggcgcttccggagatgccgggatcgcgactcctgttagagcgacttgggccccagggaagctgaaacgcccagggcgctcaattaggacttgttgaattaataatacatttgagagacagaatatacaatcgaacaatggccggactatacgtaaaaatataactctgatccacaacctggggccacctgcccaagaaatcaacttccttatgtacgaataaacaaccggggaagccagcctgctattatataagtcagactcacagggagccaggcagttatctgtagtaacaaacaataacatccataacaatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgacgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctagtcaattgatttccaagtgtgcaatgtcccatggggtaggccacaaagaggcctagagtgcaccatctgtgcggctgcagctcctggctctcaacagaactgagatctaagtcctcatgatctgatcagcttccaagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcctacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatatttttgcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacgtaatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcactgttctagaggctgggaaatccaagttcaaggtgccagcagactctgtgtctgatgagggctcactctctggttcataggctgtgccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagtggggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagtcttaacaaggcttaccttctttcttgtggtaattttttgataagcagtttttaattttgatgaaatccaattttcttattttttgtgacctctaagacatctttcctaccctatgattgtgaatatattttcctacattttcttccagaaacgtgtttttatttttatttttaaatctataattcttcttaatttcatctcctgatctcagcacaatgcttaaccactataaaatccacaacttgcagaccaacagttcaatctcccagaaacttgtataacccttgatgtaacaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcgatctttcttctgtaaaatggggctaataagagtagtcttaggccaggcgtggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggcggaggttgcagtgagctgagatcacaccactgcactccagcctgggcaacagagcaagactccatctcaaaaaaaaaaagaaagaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtttccatttctaatactgaattgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattgctttagtaccttttttgaaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacagctcaataaacctgaaatgtgtacatcctatggtgccaccatgaaaatcaagacatgctgtcacttaatcgctctcatttcactagaggacacatgagctcatgaataacggttgaccccttagccaaagatcctctattgtaccctctggagaaaataaatctctagttaccttaaaagctgatctagaggtaaaatgtctgcaacattcagcaatgaatttagattatctttgaaaaaaagttcattttcaagttgttttttttgtttcgtttttttttttttttttttgccaaagaatttctttttttttctgttacttagtagcatgaagtacaatgtttggtttgcaatttctgttctttgtaggaagaaaaactttagtggaaacaaccagtacttaaagaccattttatgaggctgtcatttacgtattatctcttttgctgtttttgttaaaatgatataaggtgggctttatatgctttctgtatatcctttggaatgtgtatttaaattaaaaacttaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttcctcccacccttgaaagtcctcgacttaaaacccatctagaacatttcctttgctaagactttaaagtattctttcttcaagttaagggcagtttttaaatagttatcagttgcattcttggaattcacagaaagcttggggagaaacaatccaacggcacaagttcaagtgcccaacggggtggagaagggactgcatactcactggttgccaggccgaggttgtccgccttgcctgctttggctgagactggagacggaaactccattcaacagcgactggaggactgaaacagggcgcaagagggcggctgcccttcacctaccggtccctccctgccttggcgccttcggagttcggactgacccgggatgttgctggagcccgcaggaactgcaaactcaccgcgcgcgtccctgcacacccgcacctgcgcctcgagaactcctggccagttgaatacccggtcccccgccgagcttcgctgcaggtcacaggaaagaggtgcagggttgcgtacccggcgggagaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggatggagggagggaagaaagatgaaaaaatcaaccaaaaaaagaacatgatttcctaactaatcggatgtgggtcatgagagaaagacctgcgtcgagtttttggcctgaacgtgtggagggtggagttgccattaactaacgtgggaaaaggcaggtgtagtacgttttagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggcgcatctttaggtcggtagtgaggtgcggccgggacgctgcaactcgctccgggacttgtaaacctggcaggtgttcgaagagggccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtaatttctgctgaaacaattgaaggaggaaaaaaaaaaaagtatgtgctttgtggttccctggtagtctagtggctaaagtttggcgctttcaccgccgggactggttgattccagatcaggggactgggtctcggcctcactgtgaggtattgttctttcctgtgtttgccatctgccaccgctgtggctcaattattccaagactgctggagaaatggaattaatgtcgatcctaaaatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatagtctcatgggtatgcttgagactttaggcccttgggacacctggtgcacagaagggtcccaaaacccatctttggaagtgttggcagagtaaataggcaccagtaataaaggcaacggcgcctgaagacctaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttattggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatgtatacgtgtgtgtgtatatatatatataaccatatgtaatttcaaaaggtaaattaaatataatgggacagtgttggtaacctcttagatagtgtagggctaagatagctgaatttatggcatggtgttgtatacttcagatatctatgctgtaatattaaaatggcatttccttggcccactaaattgtccatttcctggcccaaaaagatacgcgaaaggagtgaaaatgggaagaaaatagccttttgaaggacttgcctaataaacttctcccttagcattacttggagtgacatcagaaaattggaatgaagtaattgtgtaatgtaaaaaagacaaattctctgctgtctttctcccccaatccttaataaacaaaggaggaaacctagactcaggttaggttttctcttcttattctttacataccaggacaagtactgagcttgtttgttactatatggggacttagtatattgtacaaaggggtgtggctattactatcccttttctaccagagcatcaaaactggtaacttggctggtgttaacgggagcttctaaccttgaattcccactccatgtgacttctttctggttctctcttctcagagaacttgcagccatcagattcatttggagaagtttgataaaggttactttacgcttagacagaagaaaaaaccctaaggtcttgaactgagccttatcctctgatacagtttactggaattccctccactgtggcacaagccctgctgtaaattgtgattatctataccttgtcagttttatctatgtatatatcttttacagtaatccccacatccaccagagaacctaggttattggcagaatgaggtttgggaattctggtcctctggccagacactatcagttagtactctgattccaccatttttgaaattatatacaacaaattttaagtattgtttattttggagagttcaggttaaaggaaatgaagactattattcagtattatttctgtaattttgtaattttaaccataacataggtttcttatcaaaacgtatggaagccagaaagcagtgaagcaacaatattttctccaaaacgaacaggccaaactttggcaggagtgacaaatctggcatgcaatggtggcttctatatcagaaatcaagtcttttactttgtgagagcacgagtttttagttttttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgccccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagatgcagtagagagacttctttcgttaaagtacctgagtcaggttgaggggaagagaagaattaggagcacaaagagagcaggcacaccacaggaagcacaactctgcaattgcttttggttttaagaggctgtccattcagtttttttgggttttttttttccttttcttgaaacggagttgcccaggctggagtgcagtggcatgatctcagctcactacaacctccacctcctgggttcaagcaattctcctgcctcagcctcccgagtagctgagattacaggctcctgccaccatgcctggctaatttttctatttttagtagagatgaggtttaaccatgttggccaagctggtctcgaacccctgacctcaggttatccacctgcctcggcctcccaaagtgctaggattacaggcatgagccaccatgcccagcctgtccattcagtttcaatgaactttaaacaacaaaaaatgccatttgggtggctggtttcagtcttccctgtcaatgctcagcctccaaatattcactaacacatagaacaataggaggactgttactctcctctcacacctactacttgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacacccataattccacagcatgacaccaaactggagttactagatgacaacccaagtggtgggttgctctgtcaagaaggggccaattttatattgcagctaggcagttacagtctgtagctgtaccattgaggggatcggggcaagatgcaaatttccatggcttaccagaaacaggtgagaaactgcctgctggtagcctgctgcaagacaaggaggcccccaaaagagatgagtaagaaatagtcttatgataatggctcacaagactacttcccttaccatggtccaggagggcatttggtcaaggtttgagtcatagtatggttgagccttgcctatgtaaagtttaagcaaagccattcccttgtaccttgtaccttgaagagagtttcattggatataatatccttaatttgcactttcttctttttaatgagtaaattgcattttattttattttattttattttattttattttattttattttattttttgagatggagtctcactctgtcgcccaggctggagtgcagtggcactatctcggctcactgcaagctccacctcccaggttcacgccattctcctgcctcagcctctggagtagctgggactacaggcacccgccaccatgcctggctaattttttgtatttttaatagagacggggtttcaccatgttagccaggatggtctcgatctcctgacctcatgatccacccaaggagtctctctccctccttgtgttctggtctgtgaatggctcacacttgaacttagtgtaggctcctagtgggaggagcaggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactggtggaagcctcagggcaaggccttcacttcccagtgacactgttcccaattccctccagcatgagctgagcctcctcaggctgtggttgtgcagcagacagggtgtgaggaaaccctgctcaaccctggttacccaggatggcactgagttctaaaaagcaaaggttatgtggtgaggggcctggctgaagacctggtgtggtacttttgtgagcagtggcaccaatagaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaaatacccaacgtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagctggccacccaaccctaatcttcttcttatgcaaatgggttttctactttactcgcaccatgttgtctgctccttactgtacacgtggttagaaaggaaaagggaagatggagccaccatgttgaacatgcctaccccccaggtagccttgtcctattggcacagccgccagcagtcacctgtgcaagcttccagcttgcttatctatgtctgcagctccattttacaggctgctttttgttagaaaagaaattatttggtggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgtcggccttgtaggtgtggggtatctctagcaccagaggatcattgaggttggggatgcagggcagtgagcagatggacaagagaacttttgacagtcaatgctggagaccactgagaccataggatgttgaagcagatgctgccattgctattgatattggggtgataaattttggttgtgaaagcaacctttgggggcttgaacaggcaatccataggaaagtggatggtcaggaagaaaacacctccttggcaaggactgtcattaattatcacccagaggccccgtggagcactgggcaggaggattcgtctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgcttttgtaacttgttccacagtgatgcctggagacctgagtatgttttatctttaaaatctaataatgttactaggatattgtcttgaagttgatcatcctggtttaatttttgctgccactttatgggctctttcaatgtgcctcatcacataagtaatgtcattttcatttttgtaaatcaagtctcctagattgttcacctgaaagcctgattctcctttagagaaaaaaatgctaaaaaacaaaacaaaacaacaaaaaaaacaaaacattatatatcgcattacaattttattcaacaaatacagaggtttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggagagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaattaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttcctcgctccatagtgaggcgtgacccagcggtcagcccaaggtctagcatgcgaatcagggacgtgatggttctttgggattctagggatctacctggagaatagatgaaagtaacaaaagttttacataccaatattcaaaactgcatcaaactaccagaaacacttgccactttcaaagatagactatgctaagtagctccaggtgtgtgccaccatgcctggcaaatttttgtatttttagtagagactgggtttcaccatgttggccaggctagtctcaaactcctgacctcaggtgatccacctgccttgacctgccaaagtgctgggattacaggaatggctcttgactctaactgcaaggtccctagatcattagatcatttcctgaatatcttatgcttcaggcattggccatcacttgggttaccattgtcataaatcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccacaaatccggctcttatgtgtggtcctggagaaacaattgaaatacaatactgaaaaagacagaaattgttccaaaagaagctttttgcagtattgactaaaagctaacagtagacatccaaaaccaaggtttttacagaatacttttactagacaaaactataaatattaaaatagcttatttgatcaaactttaattccgaaaaaggctccttccaactgcgtaacagactcctatagaaaaacatcagaaattcatccaggttccttgtttctgatcctaaatcttcaatttaggacctcaacctcaaactgttgctttagtggctctgggaaggaagcactaactggcagcataggtaagtaaagttttaatctagggaagaaataagaagcagaatcagaattagaattagaagaaagagggaatatgctataccagaatatcataggcaaaaaaagaagacaaagaaagaggaaatgaaaggacagaaggtaatgctaatggagttagttatttgtggccgttttttgtaaaagagtaatgatcagtcttgtaatcattataatactattatttgctttctaaaatgtctaaaatatttgaaggaatttatgatataaaaagatgaataatgcttgcagtcagtgtttcattgtttgggagaacccagtttcctcagttaatacactttcgtgtaatagctgtttaaggagtaacatggtttaaagacatattaatggctgaaatattaacatattggtcttttgatgaagttcaaatagagagatttctttccccaattttccctggaaagattaaactgaagagaaaaatctggaaagtttgccccacatgttgggtctgggagtcattatgattttttcaaagacaggagttgtgtatgacatggaatcatgcttcttctctagttgagaagccaagctaggtccaggctgagtcataaacttgaacccaacaaggaaatcacccttcacactggccttgcagagctttggctcaatctgttctctgcccaacacccaagacacatactagttctggccaacaaaccttcacatattgtctgtgtcaaccagagctacatttattccgaaatctctttctaaaatacaaacctgtactttctactctcaaccccaaaatttacaagaggcctcatatgcatctcagagtcacagatgctaaaactcaacacaccagtgagttccctgtcagcatcatatactaccctctacctcaatgatcagccccaagccagcatctcccaaagagtagtgtgttgctgtgggtgtttcaacagatcactaaaacctgcttctacccctgcctagacacttatcctcactgctatgcatcctgctcctcaaatcagatcttgatatcttctttaaacactcccaatctcccaacacgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtatcctgagtgacctttccacagtgtaaatctggacatacctgtagccttaaatcatatctaccaacatagtagccaagcaacagcaatctcttttcctttggtcattagagtcctagagaccaagaggatgttgggaaaagaattaccatggatcagctctcagaggcagtaggttctggactcatgctggctttgatacgtgtgcattggaaaagctcaagtacctggcaatacttggagattaggaagaaaggatgaaaataaaccactgcactaaataacatgacaataatcacttatacaaaaattttaaagataaggaatatttaaagatttattagtttattatagctttatagttggagagtgaagaagaaaataccaaagctttttgtcttaacaaaatggtgcagacagattaacatatattgtcacctatgataaccagtcagcataaaaagtatttagaaaggaatggttatattctctaagagatatattctgatgtcatgttttttgctttagagtctattaatatagccacctttttgttaatgttttcagtcaagctccttttctcgcctttcatttccaacctttctctcactttctggtttagatacaactcctaaatatatcatatagttaatttaaaaatccagtgtagcagtatttcgggggtttgttttactggataatttggtccacttacatttaatgtaattgttgatatatattaattttaaatctaccatctttatttttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatccttaatttttttttttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtaataattgataccgttatcctcttcctgcacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttactctttatttctgctatgtctctgaatttccatatgtaatcatggtccttctgcctgagaaacatcatttagaatttccttttgtgttggtctgcttgtgaaaaactgtttcagctatttttctctgaaagtgtctttatttgctttaattattggagattatttttactaagtatgtaattctggaggcagttattttctttcagcatattgaagatatttacatttgattgtttcttttcagaaggcagccaattgtctcgctgctgcttatttgaatgtaatgttcctttttttcctctgttttttgtctttactatttttgtctttgtttttttttttttattgtctgcagttttactactctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaagtagactttctcactctatttgttatatttttgtgtttgtgtattaaatattattttttctccttgttatatattctgaatttttttcttcttcctcatctcccactttactagttctcttttcagctgtgactgctctcctgttaaactcttccattgagctcttaattttgttttgtttttttttttccgaatttctgtttgcctctctctaaatctattctgtcatttttttgttgtttccaattggtgtgtaaattgttaacaaaacccttttctccttctgcatgataatttgaccttaattaactttccagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctgatagcaagctataattcttatcctacatctctcggattaatctggtgccaagtatggcctctgagattcttgtgagcctgaacgttaacttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagttcatttttatcccaagattatagaaatgtaaggtcctaccttattgtaggattattctcctgataaactccccaacttgggcagactctggtcttctatttctgtcccattagtcacagaaggctgtcaaaccctaatatgcaggtcaggaaatgtccttagccaaaaaatggcttctctgcttgcttacggctctgggttccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgttcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatttgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactatgctgccaaagtgactcaaactcaaaaggacaggatgagacttactcagaacttcgaggaagtgtagagaaattatccaccactttttatcctagaggtgcttttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaagagtcaagtctatgacttacaagcttataaagatccctcagatgagttatgtacatggattgagaatcagaaaaggaaggatgctctctcaggagatagaaaaaccagataaaaggaacaactgaaattatctgacccatcccctcatcgcctgtgtagaagggaaatgcttactttatctaaccagtggataacagacagcctctttcattttggagctaccaaaaagaaaaataaattgtggtttggttcagttcccttttgaccagtatgttcttgaaatttcgaaaacattttactctttttccttttagtgtttcagtgtggataatttcatttgatctattttcaagttcattttttaggccaaaatttgtcaaatattggcaatttcatatgattcaacttaatatattaacctaatgtgccaaattcaaatttgtttctatactactaaataatatcccccgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttatttaagctttatatatttactttttacctgttaattgttgtaatcacccactaaagagtaaattctggctgggcacagtagcttacgcctataatcccagcactttggaaggcccaggtgaatggatcacttgaggccaggagtttgagaccagcctggccaacatggtgaaaccccatctctactacaaataaaaaaattagctgggcatggtgatgcacacctgtgatcccagctacgcaggagactgagacacaataaacgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtatcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatgtaggaggatgtgtatgaatgagcatgtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcctttcttacaatcccggagccagcctcatggccccctctcaaaggcatgagcatcagccagtggacacctcttcttcagagatctgagtccctgcgacactaggtacttcctctgagttccaaggccaccagcaacctccttctcagaagccatcctcccagttatgtgtggcccttcatccaagttaccaagttctaacaacccaaccattttacctttgtttctacaaccctagggttgatcactgcttcgctttctacacttactatctctgtgttacatcagttccccttttgccttcttagacctccaatacctgtataattccttgtgttaaattccctctggtatactgttcattttctatttttttttttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgatcctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaagagacttgattaactcacagttcagcatggctggggagccctcaggaaacttacaatcatgacagaaggagatgcaaatacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttcccaaaagtcccccaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagagattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactatcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagatcttgtcctctgcacacctgcaggaccaacaccatgtgaaagctgccaaggcttggggctcgcacccgctgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagacactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagactgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaaaccccttataaaaccatcagatctcgtgagaatcattcactatcatgagaacagcatgaaggtaactggccccatgattcacctacctcccactgggtccctcccatgacatgtggggattatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttgtaaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaaagaaatgaaaaagcaggaacacatgatagggtagtctgagctctgtacaaataggaacagtaacatagacaaggagtaattagagtaggctgaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaacattattgaatttttatctaaatgtgatggaggatggacaggaagagaattactgattactctcagtcaggattcatcctagcagcaattatttgtaatttaactgaaataagtccatttgactgaagagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaattgttatacacccttcctcacagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattattttattttattttattttattttattttattttattttattttattttattttttgagatggagtcttgctctatcacccaggctggagtgcagtggcacaatctcaactcactgcaacctctgcctcccgtgtttaagcaattctcctgcctcagcctcctgagtagctgggactacagatgcatgccaccacactcagctaattttttgtatttctaatagagatgaggtttcgtcatgttggccaggctggtcttgaactcctggcctcaagtgatcctcctgcctcagcctcccaaagtgctaggattacaggcattagccaccgtgcccagcaattcttttggaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagactgccatgtaggaaacaggatgtctctaaagtgaaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacaaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtacaacatctgctactcctaccaaatgctaagccactatgaggatataatgctttatttttatttatttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgtttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacgtgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcgcagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaaatttttttcaaggaatagaaccactgcacatgctcctcctgatcccccaaagtgtaagattttcatgcaaatagctatctcccaggacttacattagtaaggtatctggatataaaaatcagtgttccctaaatcagctgtgtttccattatatcaaaaataaacttttagaaattaccatttgaattaacaaagatacacacacacacacacacacacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatcatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagaaatagacaaaagtgcccactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttcaggccatgatgggaagggggagctgaacatgcctcatcataccctcctcccttttggaattactggtagaacagactctaagtctgataaaaaaaaaaaaacatttacaatctattctctctgaagtctgctgcctggatacctggaggcttcatctgaatgacaaaaccttcgtctccacaaccccttatcacaagccagatattcctttctattgataataaggaattgccaatcagaaaatctttgaatctgcctatgacttggaagccacctcacccctgcctgctgcttccagttgtcctgcctttccaaactgaaccaatgtaccttttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcacatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcagtaccttttaaagatgttgttgctacattgtcttctcacttgcattatttccaacaagaaatctgatgttttctttgtgcctctgtgtgtagcatgtctttttatctccgatcacttttgagattttctctcactaactttcagtaatttgattattaaatctttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagatagattaacaagagaaaagcagataatcagggaaaaatgagtaactctcaaagaggtggcctagaattttggcttatgtagcatcttcaactaaaagaaagaaagaagggtgttgggaaagcaagctatgggaaagtgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactccgagagggttcttggatctcatgcaaggaagaagttggagtgagtccatagagtaaagtgaaagcaagtttatttaagaaagtaaagaaataaagaatgactactccataggcagaccagccccaagggttactggttggctatttttgtggttatttcttgattatatgctaaacaagggttggattattattcctttccaggaaagggggggtgcaattccaggaactgacagttcctcctctttttagaccatatagtgtaatttcctgatgttgccatagcacttgtaaactgtcatggtgctggtgggagtgtcttttaacatgctaatggttataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcatttttttttaaccctctgtttcattttggattgtttctattgctctgtctttgcattcattaatcttgttttctgtggtctaatgtgctctcaatcccatccagcatactggtattcatctctagaagttggcttttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacatgcacctgtgaaattaaaaaaaaaaagaagaagaaactttttatctgaggaatgtgagcccctttaaattatcaggctcggagaggcattggaatgaaactgcagtcacatcactcccccttgagtgattatcttgtaaagccacttgctatacgggctccagactaactgatgccaagcagccataaaataccatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtaggtgaggcaattgcagggctcatcttttttcttccctatctctcaggggtgactgtcttttgttgcctgatgtccacagtttcaaaaaacattgtttcatgtattttgttcttttgtttaattttgtttaattttgtttcaggtgagaggataaatccagtctctgctactccatcttggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatacactaagtgagggtctttcagaatagcgcttcagtgtctgcacctgactcacactattaggcagttaaaagctggggaatgagctcatgtgaagagtttttccatttcagatgatagctatttttaggaacacaagctacataaatgttttaacccttttcccatccttttcctcttgctgctgtgatacaggaagaaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacatattcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaactcctgggctcaagcaatccacacaccttggcctcccaaagtgttgggattacaggcatgagccactgcacccagcctatctcatcttttaaaaaaaacatatcaaataattgttcataaatcattttctgtagtagagagcaatttttcttaaaattggcaaataagattttgcatctacctttgagaaaattgtatttgtaaagtgattttaaaagaatgaagcctatgagtatgatggcattataaaagtatcagtggccaggcgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaagtattaatatatggaaatacaaatgtcatatatagatgtaaattctcctaattgttcttctgagcatcatgatttttttccatgaatttttattttaagttccagggtacatgcgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcatggggtgggcactgttatactccatcagtgagtacgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagtgatgaggataatgatcatagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgctcgtatagcaatcctcaaatctcagtagcatataaaggtaagcatttagttctcacttacaagtttgcagggcaggtgaggcagctctgcctcaagccacaatgtctaggacagctctgtttcgcactgtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacataccctcatgaggctgtggagagagtgtagattcagggagcggtgagaaactggggccagtacaccaacttacagcatgatttgtcatcatttttcattctctgctagtaagattgccaaagtctctctgcactcattgaattcatttagctctctttagctctctttttttagctctcatttagtttccatttagctctctttctctcttaccacaatacctaaaaatctttttatggggttacaactctgtctcaggagccacctcagtttggtggcacagagctccccacttgtactctgaaactcttttcttgaagatattgctatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagaaacttctggattcaaatgattgtttggaggcattagccaggcattgaaccaattataaagagtgaggttttgccatattctaaccgtaagaaacagaaacggtagagggtaaaaatagaatagaatgtcaatacaactttagccttttccctggattctgagagttcataacctgaaaatcagagattcaaactgggagagatgggctaacaggtatgagcatgggaaaagcatgtttcaagaatttgagatgtatttcccagaaaagcaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagaaggcaaaagaaaatattaataaatgaattattacgcacataatgttttgtatgtacatgtgtttacttttaatacaaaagtaacggactaagttaacatagatgttccaataagataatttatgtttcatttttggcttcaagtatcctcagggttataagtatcataagctgagaccagctgaattggtttgtgggttgatgaggccctatgcctgatttgaatttctcttgaatggtctgcagccctggaccaagttgaagaagccatgagagtctcagcttttttccttaccccattatgagataaactcattccttaaatatcttgctcatttgataaaacttggcacctttctcctttctactggtccctaatacttactacctgtactgtaagctcaaattttttgcaatttctgcctttattatgtaacgtattccactggaatatgtgttacaggaaaggggtcccgatccagacccctagagagggttcttggatatccagcaagaaggaattcagggccagtccataaagtgaaaacaagtttactaggaaagtagaggaataaaagaatggctactccatagagagaacagccctgagggctgctggttgcccatttttatggttatttcttgattatatgttaaacaggggtgggggggtggaccacgcctataatcccagctactccagaggctgagacaagatcatttgaaccccggaggcagaggttgcagtaagctgacatcgctccactgcactccagcctggaccacccagggataatccgtcccccgcaccccgcccccccaaaaaaatcactgccagtaaggaacaaacagccaggacgaagtactaagatgtaaagagatgtaaaatagcccgggcgcggtggctcacgcctgtaatcccagctctttgggaggcctaggcgggcagatcacgaggtcagaagatagagacgatcctggctaacacggtgaaaccccgtctccactgaaaatatttttttaaaaaaaattagccaggcgtggtggagggcgcctgtagtcccagctaatcgggaggctgaggcaggagaatggcattaacctgggaggcggagcttcaagtgaacccagatcgcgccacggcactccagcctgggtgacagtacgagactgtgcctccaaaaaaaaaaaaaaaaaaagaaagatgtaaaataatgtgatacattctgcaagagttatgacagagtcagaaaggggcaagcatgtttcttctctaccctgaagcagccaagggagaagaagatatctgttgccaacgctggggtgttacaagtgcacactgccatgcccggctaattttttggattttagtagagacaaggtttcactgtgttgcccaggctggtctcgaactcctgagctcaggcaatccacccgcctaggcctcacaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtgtaagtatgtccatttacagattgggagatggaggaatcacagagcggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgtgcgcctgtagtctgagctacttgggaggctgaggtgggaggatcgcttgagcctgggagattgaggctgcagtctgcagtgagttatgatcacaccactgcactccagcctgggcaacagagaccctgtcttaaaaacaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacgaggaaaattagagttatcaatgattttgggggatgagtggagtgtagttttcataggctcaaagcaaagcagggctgtgtgaaagggtaggcataggatgggactttgcagtggatccagggtcttgtttcctcagaaactacaacgttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggagaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttatttcccccccctttaatctatattttattttatttattttttacttttttgagacggactctcgctctgtccccagggtggagtgcagtggtgcgatctcagctcactgcaacctctgtctcctgggttcaagcgattctcctgcctcattctcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggtcttcccaagtgctgggattacaggcatgagacaccgcgcctggcctaatctatattttaaaaattgaactcttccatgtacccctgaacctaaaataaaagttaaaaacaaacaaacatacaaaacaacaacaacgacaaaaaaaaaaaaaaaaaaaaaaccaggccgggcatcgtggctcacgcttgtaatcccagcactttggaaggccgaggcgcgcagatcacgaggtcaggagttcgagaccagcttgactaacatggtgaaaccccgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaaaaaaaaagagagagaattctgtactttgtaattagaggggtaattcattaattcatgtcaggggcatattattttatttttccaaatgctaggaagcaggtatccattttttgataatataaattttgggataattggcagtcatctggctcacagggaaaacaggaaaaacaagaaacctaaataaacttcatattgatttcccaaaaaaattaccttttattttcaacccttatagaactcaacctgcatctctttgccatccatgttctttttttttagagactgggcctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttggacctatataagaatttcttttggataaaaactcaggaacagaagtgctgagaagccagaaaccagcagttctgttcagagttttatttacatctaattgaactaaggagtgtcaggctcccctccagaatgcttgtcccggacttccaataccaaggtagctggactctgagcccacatccaggcccagtcctcgggtcatccaactttctaagttttgccagactgcctggtgtaaagtggtatctcagcattgctttcgttttcattgttccgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattttttatttatttatttattatttttttgagacgaagtcttgctcttgtccccgaggctggagtgcaatggcacgatcttggctcactgcaaactccgcctcccgggttcaagtgattctcctgcctcagcctcctgagtagctgggattacaggtgcctgccaccatgcccgactactttttgtatttttagtagagacggggtttcaccatgttggccagactggtctcaaactcctgacctcaggggatccgcccccctcggcctcccgaagtgctgggattacaggcgtgagcgaccgcgccaggcctcaacctacatttcaagtcaccatctgtcacaggataccttccactctggctctggatatgggggtcacctcctcacaaagacagacaggctgtatgtgcatacacagaaagattcagaagaaacatgaagacttttaaaatcagtgagatgattttaactttctttaaatcagtgagatgattttaactttcttctttgtagttttctctagccagttttaaaaactgtaagttgtaggccgggcgcggtcactcacacctgtaatcccagcactttgggaggctgaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgaggcaggagaatcccttgaacccagaaggcagagcttgcagtgagctgagattgcgccactgcactccagcctgggcgatagagcgagactccatctcaaaaaaaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgttgttgagacggagtctcactctgtcgcccaggctggagtgcagtggcagatcttggctcactgcaagctccgcctcccgggttcacgccattctcctgcctcagcctcccgagtagctgggactacaggcgcccgccacccatgcctggctacttttttttaattttttttttttttttgtatttttagtagagacgggttttcaccgtgttaaccaggatggtctcgatctcctgacctcgtgatccgcccgcctcggcctcccaaaatgctgggattataggcgtgagccccagcgcccggccaatgtaaatgtatttcttactgtagacttgaggtcaggagagtgggctgtactggacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagccttttcttctttccagggttgttgtggactcaaacgagaggctgttagtgaaaggtttttgtgagttatgaagctcctaggaacccaattatttctgctgccttggccacatagtctagaagaatctctacataattagcatctagagactagataatttacccattattttccatgtgcttgtcttatttcccagcatgacggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgtccaaccattcaggcttttcattattataggaagcatctggccaaggaccaccaccatcttcctgtcctgcccctgaagctgtgagttccccaagtggagacacagcctgttccccaacacctacactcatgaacatgggagggttggtcaaaattgcacagctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaactaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctccctttttttttttttttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgccggctaatttttgtatttttagtagagacggggtttcaccatgttggttaggctggtctcaaactcctgacctcaagtgatccagccgcctcggcctcccaaattgccgggattacaggcatgagccgccgcgcctggccttgctttttctcttttaaaattactgttactcatggggtatctgcaggcctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattagggatgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtccacttgcaaagacgacagatctctctacaaattctgggctgagcaggtgaaggaggctggtcaggcccatgaaggagcctagtcagccgtaaggaaaggttcactgtggggcccccgactttccattcctgatctcctttttacctctgctgcccacttcctttcctctttccctccaagtataccttatactctgctcctgatgacactcagatctccccccgcccccccgcccccatcaaatataaagagcctagtgacttttgtaagaacggtgtattcatttcctagtgttgcattaataagttaccataaacttagtggtttaaaacaacacaaatttgccgggtgtggtggctcacgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactccgtctcaaaaaaaaaaaaaaaaaaacatgaaaccaaacaaaacgaaaaaaaccacacagatttattctcttaccattctggaggtcagaagcccaaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagattccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgagaagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcccagtctgtaaagtgagaatgataaaacatctgccttccttgcaggattgttgtggtgatgtgtaagacaaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatcagagtaataacaactggtggatgtgttctcctaggtagagaacaggaatctcaatttttaatgttgggagggactttatgcatctttttgctttcaaaagcaatttctggctgggcgtggtggctgatgcctgtaatcccagcactttgggaggccgaggtgggtgaataacttgaagtcaggagttcgagaccagcccagccaacacggtgaaaccccgtctctactaaaaatacaaaaaattagctgggtgtggtggcaggcgcctatgatcccagctacttgggaggctgaggcaggagaatcgcttgaacccgagaggcggaggttgcagtgagcagagatctcgccactgcactccagcctgggcaaccgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaattttttctttctttctttctttctttctttctttctttctttctttctttcttctttcttttttttttttttttttttgatacggagtcttgctctgttgcctaggctggagtgcagtggtgcgatctcagctcactgcaagcaccgcctcccgggttcacgccattctcctgcctcagcctcctgagtagctgggactacaggcacccgccaccacgtccggctaattttttgtatatgtagtagagacggggtttcaccgtgttagccaggatggtctcgatctcctgacctcgtgatctacccgcgttggcttcccaaagtgctgggattacaggtgtcagccaccacgcccggtcaatttttgtatttttagcagagaggaggtttcactgtgttggccaggctggtctcgaactcctgacttcatgtgatcggcccaccttggcctcacaaagtgctgagattacaggcatgagccatcacgccccgccctaaaacaccaaatcttattaaatctatattctacaactctgtcacatccatcacttcatctctgcccactcctagcactgacttagctgaggacatcatcaattctgatcaaaggaccctaagtctaagtaacaataccactttcatggtaggctttccccggaaccagctggacataatgagaattttcaagagaatgtgaattgctctttacttgattttctttttttttgagatggagtatcgcttttgtcgcccaggctggagtgcaatggtgcgatgtcagctcactgcaacctccacctcccgggttcaagcgattctcctgtcagcttagcctcctgggtaggtgggattacaggcgcccgccaccaagcccggctaatttttttttttttttttttgtatttttagtagagatggggtttcaccatgttggtcaggctggtctggaactcctgacctcaggtgatccgtccgcctcggcctcccaaagtgccgggatttcaggcacgagccaccgttcccggcgattttcttttctttaagactaatctgaaagtgcggaactctgtgtacctgaaatgattacattttgatattgacatgaaaaaattgggtactactttgccccagtttctcaacccaacaaagacattccaaaagtttcctatggggcctaggaaggttggccttcacaggatagtggcaggagtgttaactttgtcctattaccaaaaggtgtcaaagctgttactaaattgtctgtgtcagtatcggaaaccccgacagcactggagaattcctcatggtccttccagaccatggtcacagtgagaagcagattctgttgccctggccctgtggggaaatccccaagatggctgctgatagttaaggaaacagtgtcctgccatggcctgaccctaggctgggtgagagagagtgggtcagacaggctgcacttcctcagtgagtgtgcatacacctgttcgcactgcctatcgtttcctcacccagtgtgagagcagggggctcagttgggctgagtggagaattcatgggacctttccatggtcaaggcccagagcttctattgtgtagcatccctggaacagagaacaggaggcagtcacaaggccccagcttcaacctttgacagtacaccagaaaagaccaagtagtgaggcctccactgtctcacaccagccaagaaagaccaggtcttagactatccagtgttcctgcctctctttcacggtgctgtatctggggaatgaatactccattgtcataggaggggcagatgcgggcggaagactcagaagggtcaaggtaggacatagacattcccactaagctagagacccctgaactgccatagccatgacatgcacacgttgtcctcaaatcccagggccatgggcaggtcttggatatctttggaattttaagttggttggcatctgtctagttttaaacctgatttaggttcagttcaaccagggagtatgattctttggggagagggccctgacctagaaatctacatgctcagcggtctgctcagccactaatggctctgacacactggaaaggcactcaccctctgggagtttcagactgtatctttgaaaacaaaattcagtggatggggtgcaaaggtattgtcctcaacagctctaagttactacttctaactcacagagcacatatcacaaaggatcccactatccattgtcggtctgagcagggaatgagactttggcagaccatgaatcctgtattaatttctagggggactataacaaaataccacagacttgggggtttaaactgagattgcaccactgcactccagcctgggtgacagagtaagaccctgagtcaaacaaaaaaaaaaaaagtgtatacatgggagcactctgtgatgagtaactcaaaggagtggttagaatttgggatctacctagcagcaggggaaaaggaggaggagtaaaggacatatggaaaaccaaatgacttttgaaaagataaatgggcccttagaatagatggaagattcgagtcttgtgacaatgtctatttgggtgtggtgaccacttctcatctccgaggttagatttgcttctagtgctgaagaagatttatgacaactgagttaaaaatttgagatttgcgaggaggatctgctattaaacaggtaagggattttagctgtttgtttcagctgaaaataattcttaagtcgaaactggcacatttggaggtagcatgtcctgatccccttaaaaagggaactgcacagacaccgtatctctgattctgcccagggtcctgtgccctctgacaccagaaatcaccacttctctcagccttgttttgcggttgttttatcatgttgcaatttggttatgtcttttctaatagtgtttaaaagcaatcaaaggcaggaacttttccttttataaactattgttgagcttatattggacactgaactaagtgtcagtttacaaaaatgaataaacaaaaatcactgccagtagggaacacacagccaagatgggggagtagtaagatgtaaagagatgtaaaataatgtgatagattcggccagagttactaaagagtcagaaaagggcaagcatgtttcttccctgtcctgaagcagccaagggagaggaagatatctgttgccaatgctggggtgttggtttaggcatgtagatgctgtgatgcgcagtggaaccgttcaatgagcagacaggagaaccagctttatgcggggagggagagaattgctcccctcatcccccgtgagtcacaccctggagattataagtttaaacattttgatttcgggagattttgagttttgggcttaaaatgactgaagaaccaccaggtggatctacgtgtctcgagtccagaagtctgaatacagatttacgatttatgagcacacagaaggtggatccaagggagagattaaacagggcacagaagagtttttaaaaataatatttttcgggaaaaaaaccccaacaaaacacgattctttcagcagaaaccagaagattttctcatagactctcctacagagagccctgataaagtaataaacatgctaacagtaagaaccccaaccaatttcatagggcagtttgcggtaactactcccagtatggagcagacagtcctcttgcaaaacccgatttagcaaactttgctagctccatgtggggcctccaaaggacacagctgggcactaaatcctggctgaaaacaaaggccgatttagaggatccgtagaaacggatgcacagaatatccctcagtcttctctatgtagcaggccctccatatacgcgggttccccaagaccgaaaatattaaacaaatgaatttcttttttaaaaaaaagtacaacaaaagatagtaaaaataaaaacagtataacaattacttacatagcatttacactggattaggtgttacgaagtaatttagagactatttaaagtacacgggaggatgtgcatagttatgtgcaaatactacgccactttctatgagagacttgagcaacctggattttggtatcggcgggggccctggaccaatcccctctcagttctaccgagggagaactgttttgtttcttccagcacggctttgaccgacagtgtgttgggattcgctgacgtccatgagaaagcttggcagcatgctgagaccaattttcccagggccagaattctcctgtgtgagctaaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccatttttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtccccccgaaagatatgttgaagtctaacccctagttgcttagaattttgccttctttggaaacagggtctttacagaggtaatcaagttaaaatgaggtctttagggtgggccctaatccagtatgactgatacccttataagaagacatggagacagccgggtgcagtggctcacatctgtaatcccagcactttgggaggccaaggcaggtggatcacctgaggtcagttcgaggccagcctgactaacatgatgaaactccatctctaccaaaaatacaaaatcagccgggcgtgctgacgcatgcctgtaatcccagctactcgggaggctgaggcaggaaaattgcttgaacccggggcacagaggttgcagtaagccaagatcatgccactgcactccagcctgggcaacaagagtgaaactccatctcaagaaagaaagtaaaaaaacatggagacatacatgaaaaaactgaggtagagattacagttatgctgccagaaaccaaagaacaagtggggctaccagacactgaaagacaggagtcttcccctagtgggtttggagagagcatggccctaccaacacgttgatttcaaacttctagcctctaaaaccatgaaagaataactttgtgttgttttacgccatacagtttgtggtactttgacagccccaggaaattagtacaactactaaaattttttgatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaagataaaatccaacatttgtttccattaccaccattgcactccagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacactgcaacagcctcctaattgctttcctcgcttctattgtggccagcctaggatttacgatccccagagcaatcagtataatattttgaggttaatgaggctgtgtgattccaagtccagtgttcccaaagcagaaaacaaacctaatcaacctcccttgcaaattggtggtccttctcctcttcagggatcccaaactctggcttcagaaatcgtatattttgttgctattgtatggaacaaacccttaaactggacaagcttttccgagtgataactcttggggaaaaaaaccatttaatggtattgggtagattttagggtatctcaactagaaagcgcagaaggttatcggtgttaactcctggttatcaaaatcgaacttccatctacctccttaaggaattttcacatgagtggtggtgtaggcacgtgtttgtgaaccaatgatataaaaacctcaggtttctcgataccatatataaaagttgagctattcccttttaagtacacatctgagagcatacaatgcatttaatctctaccttcattttaccactgaagagcggacccaacctttgttcatatacacaatttgatcttacataaacttatcaaaattaacactgcgtttctcaacaggaaacaatctcctgggcacatattcacgggtacgtaaccaggccaaagacagttcaagagcagcc

SEQ ID NO: 269 - DNA, 769186 bp, Homo sapiens
  misc_feature (411054)..(461053): n is a, c, g, or t
ttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcatcattcttgtacacttctcattggccactggtgtatttctatagggtggaggcctggagagcagttgttccagcatagtgtttacatagcttttatttaattccgttttctttcctttgttgctttattagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttgatcgccaacgtagatcggaactcggttcaccagcgacctgaggacccggcccagaagagggagtgtctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtacgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaatggtacctggttttggccatgctttgagcctttattcattctgttaacttgagacggtatataagcctctgcatcccattgtgtgtttcactcacgtccatgtgaagagaccaccaaacaggctttgtttgagcaacaaggctgtttatttcacctgggtgcaggcgggctgagtctgaaaagagtcagggaagggaaataggggtggggccattttataggatttaggtagataaaggaaaattacagtcaaagggggctcttctatggcgggcagggatgggttcacaaggtgctcagtgggggagctttctgagccaggatgagccaggagaaggaatttcacaaggcaatgtcatcagttaaggcaaggaccagccattttcacttcttttgttgtggaatgtcatcagaacaggccatttaaatttcacttcttttgtgattcttcagttatttcaggccatcttgatgtctacttgcaggtcacaggggatataatggcttagcttggtctcagaggcttgacattcctgtcttcttatattaataagaaaaataaaacaaaatagtgttgaagtgttggggcgatgaaaatttttggggatggtatggagtgataatggacgatgtttctcagggccactttgagcgggattaggggaggtgtgggaacctagagcgggagaggttaagctgaaggaagattttgtggtaaggggtgatattgtggggttgttagaaggagtatttgtcatatagaattattggtgatggcctggatacggttttgtatgaattgaaaaaagaacggaataagacaaggagaaaaacaggtattaaaggactaagaattgggaggacccaggacatccaattagagagtgcccaagggggttcagcatagccctgccatcaaagattatttatttactttaagagggagttaagagtggcaaatctggggacagcaccaggagatataagctgtgatggcttggagaaacagagtaaaccgccagtttaaacaagagcagagcatttatgagtagttgagaacggtgaatagaagtatgactagacagaagatagtagtgatgacaagtttttgggggcacagtccaagttggtctggtgtctggaatgagactggggcctaataaaaaggaacatctatacaggagcttaaatgggctgtaccctgtagcattctgaggacaggcccgaattctgagaaggcaagtggtaaaagtattgtccagtcctttttaagttggtggctgagcttggtgaggtgtgtttttaaaagaccattagtccgttttacctttcctaaagattgaggaccgtaagggatatgaaggtttcactgaataccaagagcctgagaaactgctcgggtgatttgactaataaaggccggtccgctatcgcactgtatagaggtgggaaggctaaactgatgaatgatgtctgacaaaagggaagaaatgaccgtggtggccttctctgaccctgtgggaaaagcctttacccatccagtgaaagtgtctacccagaccaagaggtattttagtttcctgtctcgaggcatatgagtaaagtcaatttgccagtcctgggcgggggcaaatcccctagcttgatgtgtaggaaagggaggggcctgagcaatccctgaggggtagtagaatagcagatggaacactgagaagtgtttccttgaggatagatttccacgatggaaaggaaatgagaggttctaagaaacgggctagcagcttgtaacttactgtaggaacacaagatgactgctttgggggtagtgttgggtagctgctattgtgctaagggctgaaattgactgaaattacctacaatttaccaactgggccttcctccagaagttgcaagccatcagtaggctccagagctctgaaatatttacatcagacagatcctgcctgtgcagttgttgtctagattccaggtgcttctcattccaccatcttcccaggatacactctgagcttctggattttgaattcagtcaagctgttctgtaacagctggggtgaaagccagcaatgatcctgctaagaaagctccctggaaaaaaaaagttcaaaagtaacataaatatcaaactggaaagaaattgatttaggaaccaaacccaggttgtcatggtgaaaaaaggggcagaaccttagctactgaactgcagcctggggtacgaggtgacaaccattgcttttttagtttggtttggctagcaaaggtggccttgttatataaataaagcccctctggtagtcaaaacctttattttctctctctctcttttttttttttttttttttttttgagaaggagtcttgctctgctgtccaggctggaatgcagtggtgtgatcagggctcactgcaagctccacctcctgggttcacaccattcttctgcctcagcctcctgagtaaatgggactacaggtgccagccaccatgcccagctaatttttttgtatttttagtacagatgtatttttagtagagtttcactgtgtttgtcaagatggtctcaatttcgtgacatcatgatccgcctgccttggcctcccaaagtgctgggattacaggcgtgagccaccgtgcccaatgaaaacctttattttcgtgatggctgcttatttatttatttatttatttatttatttatttatttatttattaatttttctttccctgctctccctctttttaaatttttattatttatttatttatttttctgcagagatttatccaattcagaggtcttgtccccataatttggaacattcctttggatttgatcaagtcagatagaactggtcaaacccaatggggaaaagaaggaaacaacaataaaaacaaacagaaaacaaaaaacagttcagaaaattaatgatcgcacaatttatatgattgcttagcactctaacggtaagaagaaattatgatcagttggttgttaatcttttttatttttttattttttattttttttgagacagagtctcgctctgtcgcccaggctggagtgcagtggcgcgatctcggctcactgcaagctccacctcccgggttcacgccattctcttgcctcagactggttgttaatcataactttaatcatttaggagaatttcaagacaaaacacaggttcagttacttacctaggaatagggcccaggctgaagactgctctgtaccatcctagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaaccttagatctcgatcaaattttgggaaatcagggattctctggagggggtggatctctgaggcctcagcaaattttcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaagtatagcagccaggtgcaaattgtgggggcctggaaataattttggtataacacagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccactcgctgtttagccctgatttgcatatgagactttgtgctagtcatctggtaacttttcactcagcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactttgaggtgggtgaagattagagcctggattaatcaagggcctgtggcttctaacaccatcagttgcctgtactcagccaccttcagcagtgctatctggctctagagagccatagcattccaggaaaggaaagaagtctgcacaaagccctgatgtttgtgtccccccatctagacagacatagtagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcatcaatgaagagtttcttcctcattgaatcactaacacgttttggatctctctgacttcctagtttgctgacctctgacctctagatccagactttaaaggcccatgttattagattagtcaacctttataatctccccattttaaggttaattgtatctgcaaaatccctttgccatacaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgtattatctgagttcctttctcaggaaaccaagcgttgggccctccagatagtatcaaagaactgaaatttaccagagtaccacatctggacaatgaaatgtcagaccccttatcccatcaaaattgcctaagtgaccacctgcttcctgttgaccaattcctctttcttacctctccctaattcctgttttcctgtatgtagttccatttcttccctgctatctaaaccctgaattttcattggtcaggaagatggatttgagactgatctcccatctcctaagttgtagtacctgatgaaagccttctttcctagcaaagctagttgactcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagagtacaattataaatacacatgcatctaatagagcctcaaaacacaggaagcaaaaagtgacagaattgaagggagaaatagacaatttaacaatagtagatggagactttaataccacaactttcaatagtggatacagcaactacacagaagatcaataaagaaataaaagatttaaacaacataacctaccagacatctatagaatactccactcaacaaaaacagaatacacttcctctcaagtacacacaggatgttctatagaatagaccatatgctagcctttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccacagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctataattccaatgttttgggaggccaaagtgtgagaataacttgggcccaggagtttgagacccacctgggcaacatagtgagaccccatctacacaaacacacacacaaaaaaacacacacacacacacaatagctgagtgtgatgacatgtgcctacagtcccggctattcaggaggctgaggcaggaggatcacttaagcctcggagtttgaggctgcagtgagctgtgatcatgtcattgcactccaggttgagcagcagagctagaccctttctattaaaaaaaagcaaaaaaaaaaccaaaaaactaacatgcttccccagtgggggaaatatgtcagtataacattggtttgcagcaagaagtatattaagatattgaccaaaatccttttattatttattttgtttttattttttgagacagggtctcactttgtcatccagaatggagtgccgtggcatgatcttggttcactacagcaaaaaacacctggacccaagcttgcagtgagcaatcatgtctcactgcaagctctgcctcctgggttcacaccattatcctgcctcagcctcccaagtagctgagactacaggcacctgccaccacacccggctaatgttttgtatttttagtagagacgaggtttcaccgtgttagccaggatggtctcgatctcctgacctcatgatctgcctgccttagcctcccaaagtgctgggattacaggcatgagccaccgtgcctagccccatgcctggctaattttttaaatttttttgtagaggcagggtttcgtcgtgctgcccaggttggtctcaaactcctgagctcaagtgatccaacaaccctggtctcccaaagtggtgggattacaggtgtgaaccactgcacctggcctctaaatcgatataagtcaattattcacacactgagaggaatattcaggatttttttcttataatataaatgatgtggaaatctggagaaccaaagaagaacaccaagactatctaaaagtgttaaatttttcattaggaagaaaatgaattcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgctgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttagatacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacatactataaaatttacccattataattgtacagttgaataatttttagtaatttacccaagtagtgcaaccattaccataatccatgcatttgtttttaatttattatttgtctgggttctgattctacttccaccacaagcttcagcatggcagtatctgccaccacttgttttggtccaagggcagaaatgagcatcctggaaaccaatcagtacttgcgctctgaactggaaaagtgcaaacagaacttccaagacctcacagagaaattcctgacatccaaagctactgcctactgcctggccaatcacctgcagaaatgtagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggtgagtgtagtgaggaatagagactaaaaccttggtttaggcatgaaactgtctttcccctctcagcaatgaatatcagattccacaaacatgtaacatcactgttggttaaaacatctcaggattcgatttaaacttttttaagagcgcccatttgcaaagcactgtgccaacagcatcaggggtgatagaagtaatagtataccctatctgccttgaaggaacttaaaactagctattctcaactgagtcacagatatgtggagatgtgaacttcaatagcagacatggaaaaaagtctttatgatacctggatcaagattctcttcccacaaaagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacctgttactaatagtcagggaagggaagctgtaatgacaaggaaacatgggaacaagggcatgagaggaacagggatattagaagaggattctggttaacatagaaattgagtttgttttccaatttctacaattattttaaaatacatcattgtgtggggggtggctaaaagttgctgtctaacttactgtcatagaaaagtaaaaccaaaagcccacttattaaagaagtgaaaagatgagctttggtgtgtggaaaaactagtttaaaaaaaaaaccttcactcattataattgtaggaaaaaaatttctcaagctagagaagaagaaagatattacctaagaccctagtataaaggtattattgtgcagtgattaaaaagcatataccctggggccaaatttcctgggttcaaatctaacttatcatcactgtgcctcagttttctcatctgtaatggtaatagagtaggaactacctctttggatggtggtgatgatcatatgatgataattcttaaaaacctactgcaacagtaccatgacaaacactatgtgttggttctccctttaaaacaccacctattagcttttgggcacatatcatttggatctttctcctctatatacagttttacacagctgtatacagataaatgtttaaatctttgaaatattttgggattattgaaactcctgacacaggaggaccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtatggtggggcacacttgtaatctcagctacttgggaggctgaggcaggagaataacccgggagtcagaggtgcagtgagccgagattgtgccactgccctccagcctgggcaaaaaagtgagattccatctcaaaaaaaaaaaaaaaaagaaaagaaaaacatgtggcgtcagacctcaggggatgtgaattctgactgcctcattccagctgaatcatcttgtcaagtgactttatcaggcttttctttcctcatctctaaaacagggagtagttgagagactgaggaatacagatatggaaatcccagcgtaaagcctcgtactggggatacttttatccttgagatagaccctgcctcctgccctgcaggcagtgaccacagcagcatggccagccttccatgatgcaggcatgtctatcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagtagggcagctcaggctggtagaacaaagagcaaatttgtgcaaggagaagggcagaaatgtatgactcaggcacagaactagactaagacacaatgaggttatggtctagttaggtctctagggttttccattaaatagcatattagtaaaatggagacagctgtctgcattggaatactagcaatgtggcttctatttgtgtgtccttggtcaaatttacttcacttttctgcgtgtcattaaactaggctacctcatttataaaatgcaaatactgacagtatctacttagagggttatgaagattaaatgcacaattgcaagtagttagaaccatctctaacacatataaaactctgaacaactattttctgtaattattatatttgtccccatttatagatgtggtgattgtcattaatattttctataagagatattttcaaactttccaaagtgcctttcatgataacaatgtttctcctccaaactttttaaaaaagtattatactaggtggagtattaactggtagggctgttgggtagatagatgattgagcagctgttgtgtggaaaatgaattattaattcgctcaggaccagcattgactatccttagagggtttcagacataaggtagattgtcgcattcgaaacttcttttaatcctttgttgaaatgaaatcatagaagctcaaatttgtaaaactcaccaaagcagagatatttgattgaaggtgggataggtctggagcccctgtttctccccagtatgtgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgggtacatactaccgggtgctgtaagttgggtaataggtagcactatctttagactcacagagctcacactctacattggaacccatgtgtattagtccactctgacactgctataaacatatatctgagattggtgatttataaagaaaagaggtttaattggctcatggttctgtgggctgtacaggcttctgcttctgggcaggcctcagaaaacttacaatcattgcagaagtcaaaggggaagaaggcatggtcttcacatggccagagcaggagagagagagagagcaaagagggaggtgcacactttcaaacgaccagacctcatgagaactcactcactatcatgagaacagcaagggggaaatccaccaccatgatccagtcactatccagcaggtccctggttggattacaatccgacatgagatttgagtggggacacagagccaaaccatatcaccatgagaaatatttaaacaataattagaaaaaaaataaatccgcacagagtaatgaaattactactcagaactttactttttttctttttttgagatggagtcttaccctgttgcccaggctagagtgcagtggtgtgatctcagctcactgcaacctcaacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcatgagccactgtgcccggccagaactttagttttaactgccttcttactgattatagtctatcttcatgtcattcagaagaatactgcccctcttgaccttttcactgatttttctttttaactttcaattaatactagagataccggcccaacagttttgaacttggcttttttttttttttttctgccagttactgcatatgaaaaggtacatgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacactgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggagtcagaggcggaggttgcagtgaaccgagatcacatcactgcactccagcttgggcaacagagtgagaccctgtctcaaaaaaaaagaaaaaaagaattcaacttgggagttccttacagggattctaagagatctctcctctgaaacttctataacctattattcactacattccctcatacattttactcttctttcccaccttaggatacatgatcccttaattcaggctcaggctgaagaactgacccacttacaacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgccccaaagtggggagaaaaaatgcaaacttatctccattatagattttattttagttttgactatggtccttaatctgcattctattgttttctctttagagcactcaggtaatcacttttcatattctttctagaattctaagttttgttttttattttgagacagagtcttgctctcttacccaagctggagtgcagtgacatgatcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggctggtcttgaactactgagctgaagtaatccacctgctttggcctcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccactgtcttctggcttacactgttccaacaagaagtctgccataattcttatttctgtttctctgtacataatatgtcttttttctctggatgcttttgagattttctatttatcactcgtttgaagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaatttaatttatgtctttttttaagttcttctatgtaactcttcatcatttcatattttcctctagcttctttattttattttattctattttttgagacagagtctcgctctgttgcccaggctgaagtgcagtggtgagattttggctcactgcaacattcacctcctaagttcaagtgattcctgtgcctcagcctcctgagtagctggaattaccggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctctccaagctggctttttaatttttttcaggcagcataagagcagctattagtcaactgctattttttttcccactatggaggcaaaatgacctttaagaaaatagaccttattttttagagtagtttcagattcacagcaaaattgagcaggaagtacagaaagttcccatataccccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcacgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccgatgctaatctaatgccatcgttgatctgacaggaggctgagctcaggcggtaatgctttctcgctggctgctcacctcctgctgtgcggtcccattcctaacaggccatggaccagtgctgggggttggggactcctgttctaaccaatgctccctctattaaaagggattttcacactagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgtcttcttcaaagttactaccaggctctgcctgggtcctccctccctgctctacagttgacaatctcaggcagcaaactggagcaatcatagggctcacctcttttatttattatagtactgcactgtatccaatgttgaagatagagtttaaaatactttttccagtttctcagttgtttaaggtggaggacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaagaattacccccaacaacatctgaggaagcacaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcagccaggcaagtattctttgagctggggaacaaaaggcatttaaaactttttgctctgcttcaggcagctgacgtctggtgatgattcaccatatcaggaacaccctgtccagtgggctaaggcaagcctgccaggccacttctctaaagacacaacctgaggcctcctgcaataattctcacagagcattctgaacatacatgtaagctgttatgtccctgatcatatagggcccatgtgtgcaatgtgtgaaatgggacctgcttaatttctgactagctctttctaattttggtttgcagaaaatcacaatggtaagaaaaatgaagacaggcaaaagccactggctcccaggtaactctacatgatgaaggggctgataatggactgaccaaatctagagagaattccagaagcaaggactcaagaggttgaaggtcccagatctagaaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcattttacaaggtcaggagttcaagaccagcttggccaacataatgaaacctcatctttactaaaaatacacacacacaaaaaaaaaattagccaagcatggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaggttacgtttcatttccatatcattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatggtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttacagtctattggatattatggtgaagggcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttgaatcaacttcattcatcatggaagaatgttccattcataaacagattaaagagtaccttagatccatagaaggtgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgatcatgcgcttactctgagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcatatgcaaaagggctatgagtaggaggaaaactcaggcctctgaggtctcctgaaagagttttgctaatgtcacaactggctttctatgttatctgaagattgagatctccatgaagagtgaagataggtaatgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatacttgcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcatctagaggggtcttactggaagccttttactcagtccctttaatttccttgggtgtatactacggttccactgacatggatgacctggtagtagcgcagcagcctgaaataccagggtttccttagctgtggccttagctgctctttccaaaagggaatttcctctaataagaacagtgtcttccttctggtgtcccctgcagtgaatacttgttatttctttgggaattggacggcatctaaaagttccaagatctgagtaaagttgtatgggggatcccttggctcttgatagtcccctttccttccctatggttgcatgagcctgaagcacccggaaaccatacttagagtcagtaaacacattgactcttgagggtttttttttcttttttgaaacggagtcttcctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgtaataatccatacttcattatcaggggatggatgccccttggagccaaaggtctaaaaggatactggatttttctttttttttttttttttgagtcagagtcttgctctgttatccaggctggagtgcggcggcgcaaggctcactgctacctctgccttccgggttcaagcaattctcctgccacagccttctgagtagttgggattgcagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatattttttttcccatagataattaacactgggtttcaaaataacctggactgggagaacatttgcagttcttccaggaactaccatgtcacaagcagacgggtctacttgagaagtaatatttgatggaaggaacgtcttttctttatctgtgttaagacatgaacttagagctaggagaagtgtcccttcccagcctgtggccttctcttgaggtgctccaaattgaactgcagcctgttattgggaaagtaagtctcttcccagtaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggccccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccgagaagctcagactccgtttggagactgaggcagtctttcctccagtggccctcttgcttacagaaggcacactgattccagcctaggggatgatgagctggcttttgtctgggcatcccaaagccactcttgcaacactttctcaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagagcccgcccttccgggttgtctgggtctacattagtatatttcctgagtgcctcaaccaagcagccctaaaacagaatgggattttcatccttccactgagttacttctctatccttgtcacaattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatacttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtgggggatacaggctggagctagctaaataaaagggagggttttctgatgacattggggtgaaatcccacactggagaactggcaggacccctcgcagaactgggggactgagaagaccctggagagggcatgggccctccagggggtgccgctaggaagggagcatcgaggatatcccacgcggtttcttggtgcctggaagtaacatgagccagacacatcctgcagttgactcttaagtcagaatcctggtagggggccatagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagaagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaaatatttgggcaaaatgtttgggtggctgctgcttgtctgccactatgggtagttgtcacttgggccaggggtccaggaacccctggtccctgtgaccaagagttcaatatgggcttgagcaaagtcacgtaggagggggcccacaactggctgttatggaaaattgtaatcttttaatttaagggcggagaagatgacatccacactcctccagggaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcactaccaagtgtcctgccttaaacagttcttgactctgtcctgtcctgtcctgtgttatatcatgtcctgtcccatcttgttttgtctttgtggtcaccagatgatgcaaggaaggacaaccccaaaattggggcttagcccaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggttattcagaactttttggaaaagggatgaggagtttccagaagcatataaggtaacttcctggccattgccatggcaagttgacatggcatttataaactgtcatggcactggtaggagtgtctttatgctaatgagcagtgagggcaactagaggtagcttttgtctccatctgctggttttggtcagcttctttactgcaccctgtttggaccagatcctgctctgatcaactgggccacaaccgcaaaataagtcctgccactttcctgcctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacatatcattagctggaagctgcctctatccatatattaaaggtttctccatatgtagtgaactgtaacctaactggatgtgtaaacaacctgtaacctactcttgagccaatgactgaggtttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtattatatattatatacacatgtaatatatatatgtatgtgtatatataatatttatttgagagagagagaagtgacttgtggtactgatgttgcttgcctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcatgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccaggaccatcaaaagcacacctgcactaggtcattgggaactttggaggtgccttacatctgggcatgcattgaaccaccacacaaggtgaaatgcctcttctcaaagaggcttgcctgcagtttccactaacgaaattgtgagtcatagctgttcttctgtttgagatattaggagggattttgtggggggtgaggggggatgaaagtgagtttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaagtggaaagattgactgagcccagcaatttgagaccagcctgggcaacatggcaagatccccatccctataaaaatttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagcgtttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcacgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaacaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggacaccccactggccaacgggaccctaggcaaaccttataaactgagtcccaggccaagaaggaacgggaggccagacaagcctcattatattcccacccttttgcaatttagacaaaactgaccaacattaatgttatcacagagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaagtttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcattatctgtgggagagttactctgaaagcagcaagaagccattaccagatgcagatctcattctgtcagtaatggcaacccagcaaataggacaggagccccacccaggttggatcaatgcatggctgtataaccttgagcaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcaccattaactccccttcttcaccagagttttctggcacccaagactacagaaactctcctgcagtgggctttggggcacatcgcaagttccagtaacaagggctaagatcgcccgcttttggagaccttacaaagcatgtattccctgaccaggaatcgaactcgagctgcaggcggtgaaagcgccgaatcctagccactagaccaccagggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttaaactctctattgaaaaatgaacaaatgttcagaacagaggaagtagagtggtggcaccatcaaaggcaggaagggccaagagaacctgatgggagtggggatatagacctggttctagcttccagtcttccagtcactaactttctgctgtgtgcagggcacaatggaagtaaacaccacccactatatatcccctgtgcctggcatacagaatcattcatacatgttgaccgaagggtttcctttgcttctaggggattatgtatcattttgggaggaagcatgtattctgtgaggttgtttagtttatgtccaagtgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtactctttatcatatgaggagagtgctaattaatgtgtcatttattttgtgagcatgctaataaatatattcatattccaatttagtgaaaaaaaattgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttctatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagctgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctctctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccatgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatatgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgattttttgctgtgagacaaacttgaaaagttcacagacactgcctttctctgaaaactgcccttacctctttgttacaattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcctgtgtccttcagtggtgatggctctgaaacccttgtgttttatgaacttcatgccctggtcttcaaacgaattcagtgcaggccaagaagcacagtttggcctgggttggatgctctatattttcaaacagtgaaatgccttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcaggtcaggcccttcagcctggtggaagagcaggcagggagggtcctatggttcctgggaggacccgaagcatgatcacctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgtggaaccgtaaatgagggttcagcctgtctgcctgagggattgtgtttcctggcgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacacgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaatcccaagaggtagatgttgcggtgagctgagattgtgccattgcactccagcctaggcaacaagagtgagactacgtcttaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagaagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaatatatatatatatatatatatatatatatatatatatatatataaaaattagctggacgtggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaccgcactgaggggaaaagtcaatgtgaaattctacaaaagctgaaaattcactaccaccagccattaccacaaaaaaaaaaaaaaaaaagttgaaggagtcctccaggcagaacgaaactgacatcggatgaaaatctggttgtccaaaaaaaaaaaaaaaaaaaaaaaaaaaactagacatgacatctaatagaagaatatataattttaacatctgactgtttagctgggcgtggtggctcacgcctgtaatcccagcactttgggaagctgaggcaggcagatcacttgaggtcaggtgtttgagaccagcttggccaatatggtgaacccctctctctactaaaaatacaaaaattagtaaggtgtggtggcccacgcctgtaatctctgctactcaggagtctgagtcaggagaatcgcttgaacccgggaagcagaggttgcagtgagccaagattgttccactgcactccagcctatatggaacctagtttgatctggagggatcttattttataggaggcttggagggggaccttttgctttgtgtactcataggatgcacaagacacaagggaacaatctctcactttttaaatacagtgataggcctgaggagaaacaactgcaaattttttttttttttaatgagatgggattctcactggtcttgaactgagctcaggcgaggcttcccctacgtcggcctctcaaagtgttgggattaataggcgcgagccaccgcgcctgaccacaactaaccaacatttaaaagcacgtccctgggtaggctcgaaccaccaactttccggttaacggccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttccacgttagaaacgcttgcattgcctgactctgaaaccagaagggcggccgaatggccttcaccctccgttaaccctcgcctgcttcagaagccagtgcctctggaaatgcctggatctgcgaccccagcctgagcctagtagggcccaagggaagctgaacgccccgacggctctcatggtagctctttctgtttttttgcgccgccttcaggcaatcatctactccgcttgctatcccctcactcaactcggcttcagtagatggggttggtggggcgggagcgggaaagaagcaggggagtcaaaagggaaaacctgaaaagaaggagggagaagcaggggagaccaggacaagacaatgggacagcccaggatgccggtgcagagggcaccggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggggaccgggagcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgtgtcttttggtttgcctttaattcctgcaccagctgcggcctttatctgcagccagaaagcaggttttaccgctggtcccacagcgccatacggtctggggaaaagaaggaaacccaatagtacacaaacaaaggccaaaagagaaaccttccaagtgctctatgccttacggtttagcagaaaatatcaaacaactctcaacctagctggtctgtagcttccacaaatgaaatactgtattcattgcagcctttctggttgagatatttcaaatatttggtggagcttttaatgagacggagagacactctcgagtgtggaagaaaaaaatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctacagggacagcacagcgtcctcgccctggccggacgctcagggtcaccaccctacccactgcccccctcgccattcttccaaaccactctctgccaaagattccaccgacagtcaccccacacgacaacccaggccgcctttcagcagcggctcccgccccgcaaccacgcgccctctcacccccgcggttctgcccgccgcctctatccagtctgtgcacttcacctccctggctcccgctctcccctgagcttacagtggacgcggggttcttccgaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacagctcagcccgataggcacctccggggcggcgacggcaaagagggtgcccttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctagctgcggaggctgttctacatctgacccttggagcaggccggctgacagcgtagtaaaggaagatttctgcgggagggcggccagtgcaaaacaattccctgaccgggaatcgaacccgggccgtgacgctttcagcaccgaatcctagccactagacaaccatgcagatgcggaaagctgctttctctcccttcttcgacctgaagcgacactttcctgtgctctaggaggacttgggtcttgtgagagtcgctctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgcgaggcggcagcaactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcaccaattcgtgatttccgtcggccaagtgcgtgggcattgatctacacgtgagtttctccacctctgccgaatggctacttcggggtgggggaagggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttttcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcagatgcgcggtgcgcggggaagaagaggatttgactgcggttctccacccccggcgcctaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatgtaaactgggtggctaattcacaacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaatgggactaaatccagactcagttattgcaatgtgtgcaaaagaacaaggacttgtactatctgacttcaaggcttactataagctattatagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctccgttcttctgtggttagaagacctgaacccaactccctccccaagcactggagatggggcttttccaagggctagggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagttttttttttcttcttcctttttttctctagctaaacaagcactggccttgagataagcaatgctgaagcacttgcagctcacctattaccaaaaactgactgagccctccctacacaagccataactactgctttgattggacaagagactgatttcagtagttttctcttggtaagagaccactggccgtgggctggttctggacagtttacagaagctatgcacttgattgcctttgtgtccctgcttcaccttttgaagcatagggcctaattataatgtatttaaatgttgtctccaccccaaagtgaacatgggttgcatgtaacaggcgtgtttactcagcatgcatgcagcaggatcccttcacaaatattcagagctccccctattccctgttgaatatgtatatgtggccaaccagatcaacgtaaatcactattcgccctcccctccctggaaacttacttttcgggtttcagcaggaagctatgcctcccagtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcaaataggcctttgcaaaggagaatttcttatatgctggaagccataaaaaaatatgcttcatagtattgctcattaggcaagtacaaattaattccacactgagataccactaaccaatcaccagtgtgtggctacttttttttttttttctgagacagggtctctctcacccaagctggagtgcaatggtgcgattggtgcgatcttgagtcactgcaacctccccctcctgagtagctgggactacaggtgcatgccaccatgcctggctaatttttgtattttcagtagagacggggtttcgccatgttggccagtttggtctgagagcatagctacattttaaaaagttagcacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccagtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtggactaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctacaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcctggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccctccgggagcttcatttcttgttcctctccgtagtggctcagcggtaagcccaaggtccagcacacgaatcaggaaactgatggttcttgggttagcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatatcttttgctgctactttggtcagcgttgttgtcagtttaccttgtggtggccaagcccttaaatgcactattaggttatgcagtgtaattctgcagggcagaagggtaaagagccatagtgaagagcaaaaatacctcttatcttgaccgggaattaaacccgggtctcccgcgtgggaggcgagaattctaccactgaaccaccagtgcctctctctagcaaccctgggagaattatcaaaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcagtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagtagagagatttcttttctcaattttccctggagagattaaactgaagagaaaaattcagagagtttgccccacatgttgggtctgcgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctatatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaatagcgtttaagtttattggatactccacaagcttactgccactttattaccacacttttccatctatcggctcttgcatccattaacataagcagacaaaaaactggactcctggccgggtgcggtggctcaagcctgtaaccccagcactttgggaggccaaggcaggcggatcacgaagtcagaagattgagaccatcctgactaacatggtgaaaccccatctctactaaaactacaaaaaaaaaaaaaaaaattagccaggcgtggtggcacccatctgtagtcccagctactcgggaggctgaagcaggagaatcgcttgaacccaggaggcagaggttgcaatgagccaagaccacacaactgcactccagcctgggtgaaaaagcaagactccacctcaaaaaaaaacaaaacaaaaacaaacaaaaaaaaaactggactccctacagccagtgtagtatgcaccactcacttgccacactgtatgctgagtgacccttccacagcttaaatctgcacataacttcagcctagagccatataatgtccctttatttcttcagtacaatgattaataccatattctctgtacccttcttccctctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagctgattcacctccttggtgagggctctctccctggcttgcagactgctacattctccttctgtcttcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccatcctctgcagtcatcctgtcagtttccattccattctcctatccctggcttgctggttcaatactcttaagtgatttactgctggtgctcttctttttccctcagagataccttgtgatttctttgattctctccacctctacaggttaataagtctaatatttaaaaactctgtagaaggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaaacgcactgccgagaggccagaaggcaaagcgagagtcggtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagagctaacaaaaaaaaaaaaaaaacttatgtttccgcccggtttcgaaccggggacctttacgcgtgtgaggcgaacgtgataaccactacactacggaaaccacaggcggaacctgcacggcaaaatataaccatgaaaatcttagatcagccgtttctattatagtttccaaatccgagatcgcaccactgcactccagcctagacgacagagcgagagtctcaaaaaaaagttgggagaagaaggtgccattttccctagttgcttttcttactgcggtggtgaccgcattgccttcacacctgaagtccaagtgcttccaccctgcagaatatgcagaccgctgggtcactggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccaaaggaaaagcgcaaaggcggcccaaccccacgacctgagcaagccaagggtcgcgggttaaattgcgtttatcagaacagttgtttgctcactgtcccaaagccctcctagggacaaagaaaacactggcatggcaccaatcgcagaagggggcagcattgacacccaggaacaggagtggaaaagcaggaaaagcagggatcatctctctcctaccccgtatatggctgcagacatagcagtggttcttttctccaggacccagtgagtgtgcaccaggagagaaaattatgcacgttattcatggtggcaccacccaggctgaaagtgagcctgtgctgcttgggctttcaggaaggacggacccaactctccctccctatacagagctgcagtgccctggcaatggaggacagaccatggagttgcctgccctggactcggggaagaggctctgccctaaaccccattttagtggtagctgtcagagtggcatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactgaactgcatcctaaactggaccactgaattcaaaaaccctgctaccaaagggcttagtgctagtccatgagataagtttcctgagaattccgtaccctcagcccccaacaagggttagtgtgttagcttttacttccaacacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaaaattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgttggaaatgacagataagaattccaaatacggattgcaagggaactcaatgagatccaagaaaaagttgaagtccaatgcaaagaaatcagaaaaacaatacagaatatgaaagacaagaaaactatattaagcaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccattgaaaagcatacagtcatcagacttcccaagataaatgtgaaagaaaaaatcttaaaggcagctgaagaaaagggccagattatctataaaggaaatcccatcagactaacagcaaacttttcaacggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatataaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaggcatagggtggcaaattgggaaaaaaaaaaaaatcaaactttccatggcctttaagagagacctatcttacatgttatagcccccagaggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttaaattggactcttgactaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaaattgaaacaaatgaaagtagagacacaatgtgccaaaaactctggaatatagaaaaacagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcgagcagaactaaatgaaacagagataaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttgaattcctggaagcacacagcttcttaagattgaaccaggaagaaattgaaatcctgaacagaccaataatgagttatgtaattgaatcagtaataaaaattctactaatctgaaagagccctggaccagacagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaattctcaacaaaatactagcaaactgaatccagcagcacatcaaaaagataattcatcatgatcatgtgggctttattcctaggatgcaaggatggttcaacagacgcaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcaggttacaacatgagcatacaaaaatcagtagcatttctatacactaaaaatgctcaagctgacagccaagtcaagaacttaatcccatttaaaatagccacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcacacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagctgagatcatgccactacactctagcctgggtgacagagtgagaccctgtctcaaaaaaaaaaaagaaaaaatccccatggaaccaaaaaacagcccgaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaactaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcttatgactaagacctcaaaagcaaatgcaacaaaaatgaaaattgacaaatgggacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaattctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcgccacagccagaagagtgactctgagtatatgaatgaggggctacagtggactgtccagtacctagggagggagagacagggctgcaatgaagtctggagggatttaggaaattcattgattgtaccaaacaaaaacttacatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacacgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttccttctggaagcctgaaaactccagtttgcttccctgagcccttttcctgttgcacaactagggtgtggactacaggtcctacccatggaagatggaggtagatacttcacagggaataaaaacaacctagacaagtcatacctttaggtaacagatactttcaaagatgtactttcctgcacccattaaagttttagtctcagctaatctgaaaacctgcggtcctcatgcactgggatagcagtgcaatatggctcaggctcaggttttgctgggcacaccagagtaggccacacactctcatgtgcagtggcttcaggtatggatcagggtctttcccactaattggcttcagttatgatgttgtaggtcatcattcttctggctttaatatgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctccagcctctccctcaggcggtcattgagactgatggactcctccaggcgctggcgcaggttctgcatctcagcaagattcttttccagcaggtcggcccctactgcaaaccaccaagacataggagaggtaggaggtagggaagcctgatcatccctgggcagctgtggggcctgcctggcaactctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagagggggaacaggagagaagggaacaatctccaaggaaggaaaaagatgcacagagagaggaggctgagaataggcctcacccactgggagattttgcgtagggtcaggtttttctctgagaatttaaaatgtcttattgttacactacctgggacacagaaatggagctgcttcaagccattcctctaaatacctgcactcctagctgccaggtgccaggatgtttggctccaaatccaaaagcaatgtttatgggggcaggattggcacgtggttgtatgcacagtgtgtgtgaaagatgtgtgtgaaagagtggaaagagtgtgtaggggtgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtaagttcctaggtagggtggctaggagaaggcactttcaaagaacaagcactgagctggttctcactgtctggctgatctacatattgtcctgtcattttttatgaaccaggttctaacagaggaaccaaaaagtcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaatgagtgttttaaaggtaattatagtgagttgaatagtgtcctccaaaaattcattcagttcacttggaacttcagaatgtgatcttatttgtaaatgggttttttgtagatataataagttaagatgagatgatagtgaattgggggtatgtcttaaatccaacatgactgatgtccttatgagaggagaggagacacagagataaagagacatacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttaggcgtcttcatctccagaactgtgagagaatacatttctgttttaagatgcccagtttgtgtttttttgttttggaagccctcgaaagctaataaagcaatccacggaatgaagactaaggcagatgtcagcagactcatttcccaaggactccccatttcaccctaaagtaactggcatttctcagcctatgacataagcagtagtgttagttgtaatatctgagcatcacagcgcacatacaggaaaaatatggggcccctctcctagcttcctttatgattcccaatgctggaatgaacctggggaggtacttcagaaatgtttctcctaatagcaggactcacagccaatcctaggagttcagacagtgaggggtgaagcattttgttggtctgtaaacaggtgactatttattcaacattctatgcccttgccagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccacagaatagctagtgtactcttgcatagaggattgtagaatcacaaaatacatggcatcttacagctcaatgatgccatgagaacatggccagatcctctgggcccttcattactgtctccctttgagagaaaaacccagctggggtggcagggccataattcagagaaaagttttagagtctttccctttcaaggattattatcaagggctaaagaatagacaagtttctcctctgagcaggtgggagtgaggtttctgtttgccctcaacaacatcacgttcttttaggaactgtatatttaaatcagtaaccagtaggtctctccttctccaatttataaaatatcagatactaattagaatcactgtgagataaagagtaatgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacattctctggccataccacacggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaaccgttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttcagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaatccattatgggccgggcatggtggctcatgcctgtaagcccagcactttgggaagctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactctgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcctcttcccgtctctatcaaggctatcccaaggaccctctcagggaaattctcaggagggacacgctggttggtgatagactcagcttgaacctcacagcatggccccattcactgatggtttagagggtgttacagcaaacttattaggatgatggatgggatctgtaaatgcataaatgataaagatgatttagtgatgaacaaaaaataggaactgttgctgtttaccccagggattccaggattaggtgcacaatgttagcaacactcatgtccctagtttgaaagatgacataattgtgtgcagtgaagaggaactatttgccccctttctccccttcccaacccatgccccccaagaccaagaccatgtatgtgccagaggagatctagtgactgatggcatgtgagactgggaacggagaaaagctacctgaaaaccttggggcttatgctcagcactgagtcctggagctgtgcccgaccaggtacatcacggtggatctacagggcccggctgcaaagatgccacctcttggcctagacaatgcatgagcccccaaaaactggagccatgtggctactcactgactacagtcactgaaggatgcacttcctccttgtcaagctgtggagacgtgctgctcagggagtgatgtggggtagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctgagggctcacaggagatgtaaaggggaggtcaagaggatcattccttcagaggagaagccaaacaaatcatttctgtttcaggatagagtatggagggaaggcggggacagagagagcaacagttgtccggtgcattggctacaaacatcctgaggaaaaacgaagccgtaatgggccccttaaataacactcatgattccttcacaaaacacccagagacccataagagttcaactccaggtatgggcatggcggtacatgcctgtaatcccagcaatttgggagaccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcatgccactgcattccagcctgggcaacagagcaagacctcatctcaaaaataaaattttaaaaatgtaaaaaaaaaaaaagaattcaactcattctgtgaacataatttttaaaatagtatttgccataggccatttaaaacagattccccaggcaatgtagcctcactggtgtcttgcagtttctagatctccttccctaagtatagagacacagtataaacttttgtttgcaagaaaaatttgtagccgttttacatcttccagcgctccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatcactaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggaccagagacttgactacctgatgcttgccttgattccaggatactctgaattttctcagatcttgggttgagtctttagagagcttgtctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgttccttctgtctttctgccaattagtttcagaggaataccatcatccctggggatgcctcctgccctaacagtcatattccatgagggatggaggtgctggtgatcatcatggcatcctcaacccttcttcttggagctcctctccagccagtcctgactctgtcatggtcttaaggtggtgattacaaagcaggacaccaggttgaaaagtgacatgtgaatgggggtggcatcctgtgaacttaggaccttgggagagactgaaaatcttcctaagctctgcggccaacttacctgtgctgaattttctggcaaggctctctgccagctggcttcctttggccagctgctcgcagtagtgctgctccatatagtggtcaaagttattgctctggagtagctcctcaaaggtctttagtgtgttcttgacatgctggatgagaagagcagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaatctctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttatctatgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaggccgggcgcggtggctcatgcccgtaactccagcacttagggaggtcgaggtgggcggatcatgaggtcaggagatcgagaccatcctggctaacacggcgaaaccccgtctctactgaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagaggtcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaatagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatgtttgacaaagggacaagggcaatacaatggagaaaagatagtattttcaaaaaatggtgctggaacagcgggacatccacatgcaaagaaagtgaatctagacacagacttcacattcttcatgaaaacttactcaaaatggatcataggcctaaatgtaaaacataaaatgataaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttacttgttggagggcatgatcatggctcactgaagcattccttgggcatgatcatggtgtgattatggctcactgcagccaaactcttgggctcaagtgatcctcttgcctcagccttccaaagtgctgggattacaggtgtgagccaccgagcccagctatatgattatttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagatatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagtttacacaaaaacctgcacatgatgtttatagcagctctattcataactgcaaaaacttggaagcaaccaagatgtccttcagtaggtgaatggataaattttgatacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagagagtaaaaagatcagtggttgccaggtgttaggaggaaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtgggttcatcagttgtaccaaatgttatcactcgggggcaagatgttgatagtgagggaggctgtgtccttgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattctaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgttttgtctgagatggaatcttgctctgtcatccaggctgaagtgcagtggcgctatctcggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgtgcctggcctagcgttattttagccctaactaacattattctctgggtcagtgaaatttaagtggaatatattgggcagtgacctaatggagcatgaagcaggatttgaatcacttccaaagctgtacaccaaccacttaggcaaagtagtgatttcagtaacttagtatttcagtaactggtgctcacaggcaaatgcgtaatggattaaccccatattatttaaatgcttccaaaaagctataggaaaatggccattaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacgtatgaagaaacaggagattcctacatgctcctggggatccagaagagagaccactcacatgactggaagatttccagctcaggtaaccacaaaggccatatatttggtgaatacaggcaatgttagttagaataaaaccaaatttctctgaataatataaagtcattactaataaaacttttatagatttttctctgaagaaatttccaggaaggtgttaagagaaagccctacaattaaggtatggaggctggctgcaggccctgaaagctgctctgatgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcagggtgggtgctgttatgagaaggaaggggaggtcccacaggtgtttagaagaaaaagcaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttgagatgccagagctcaaatcccatgtcactgggacatcaacaatagtgctatggggaagactcagggtgccagctcttgagtcacaatcacagaattagaatgtggaagtagctacagaacccaaggaagccctgccttctgatagctacactcaatgcaaggctgcgtatttcaccctggaggtctctaacaggggaggccaccccctcaatagccagcttttttacccttttgcttacgttgtcaaccaatttctaaccacagcaaaataacctaagtatacctctccttgaaaacatcaaaacattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtattactttttaatacataataaataatatatcccaatgcgatacttgcttcctttcccttgcagtagcaacgtgtaggggtttcatttaatatgaggtcgatttgagccttccaaactcccattccacccacctttgcttgcactcatgggaaggctcagtctatatctggtttgcccacattcctaggctacagacctctaggactcccagtttgagaggcgccatttttttggagggtagtgaattttgatttctgtctcctttgcatccttcccagtgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacacgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaagagaagaggccattggtagtatatacttgcatttttcttgtaatacttgcataagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattgtagggaatgttaaaatttctcactggtacagttagaaatgaaaacaaagacaataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatctattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggatatatactcaaaagaactgaaagcaaggattcaaagagatatttgtgcacctgcatcaatagcagtattacaataactaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggacattatgcaaagtgaaataaaccagtcacaaaaggaaaaatactatataattctgcttatatgaagtacctagagtagtcaaagtcatagagacaggaaataatggtggttgtgccaggggctagggagggaagaatgggaaattaatgggtatagggtttaggaactttagtctaagaaaggagaatattggatgccagaaattcagttttctttctgttccaagatccctttagctagagcgacatattgaagtcagagttcctaagggaaaatcattgtgtatggagatcatccttgtggatcaaatgtgaatcaatagtagatcaaaagatattccacttttgcagatattgacatttgttggacccgtaagattttatctagtattagatagataagatgtgaaccacttctcaacgctgcagactcaaatactaggaaatactaagaacctcaggacaaacaaatagccagtccaaaaagactcacagactagataagctgtcatctaccacctaacagataatgtatccctgttaaccactatctccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataaggtgcaggattctattagctaagattatgtctcaggtgggcaaatctctgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagtctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatacaaaatatcttggaagtttagctgaagagatgaggagatactctactgctcaatgtgcgccatgtcatctgttgtacctccccttagttaagtcaggagggcaacactccctttattttttattttattttgtatgtatgtgtgtgtgagatggagtctcactctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcggcccctctatttatcagacagatgtatagaaagtttattgtgctagcaagagtatgaagaaaaggattctctgagttgaaaaaacaaattggaatataaattggtaccacttctatggaaggcaaatttacagggcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgatcgagcaattagtaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactacatttctttccaacagagaccttcttggaggatgagaagcagccactagttgacaggaggggaagtgaggcatgtagtcttcaagggagcagaccaccgtgggagttataaaagaccagcgacgcctctgggtgggttcgaaccaccaaccttttagttaacagccaaacgcgctagccgattgcgccacagagacatggctgagctcctaatttcgttctataagagggtaagctgtcactaaacgctagctagcaccatccgccttttgcaaaatgactgggtaatctccaaagcctcggaaagccggagcagtcagagcgacgaatctacttgtttgtcaagtttgaaacctgtgcattgagtgattccgaaacgccccgcaccccgccttgcctgcctcagaagccggcgcttccggagatgccgggatcgcgactcctgttagagcgacttgggccccagggaagctgaaacgcccagggcgctcaattaggacttgttgaattaataatacatttgagagacagaatatacaatcgaacaatggccggactatacgtaaaaatataactctgatccacaacctggggccacctgcccaagaaatcaacttccttatgtacgaataaacaaccggggaagccagcctgctattatataagtcagactcacagggagccaggcagttatctgtagtaacaaacaataacatccataacaatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgacgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctagtcaattgatttccaagtgtgcaatgtcccatggggtaggccacaaagaggcctagagtgcaccatctgtgcggctgcagctcctggctctcaacagaactgagatctaagtcctcatgatctgatcagcttccaagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcctacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatatttttgcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacgtaatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcactgttctagaggctgggaaatccaagttcaaggtgccagcagactctgtgtctgatgagggctcactctctggttcataggctgtgccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagtggggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagtcttaacaaggcttaccttctttcttgtggtaattttttgataagcagtttttaattttgatgaaatccaattttcttattttttgtgacctctaagacatctttcctaccctatgattgtgaatatattttcctacattttcttccagaaacgtgtttttatttttatttttaaatctataattcttcttaatttcatctcctgatctcagcacaatgcttaaccactataaaatccacaacttgcagaccaacagttcaatctcccagaaacttgtataacccttgatgtaacaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcgatctttcttctgtaaaatggggctaataagagtagtcttaggccaggcgtggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggcggaggttgcagtgagctgagatcacaccactgcactccagcctgggcaacagagcaagactccatctcaaaaaaaaaaagaaagaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtttccatttctaatactgaattgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattgctttagtaccttttttgaaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacagctcaataaacctgaaatgtgtacatcctatggtgccaccatgaaaatcaagacatgctgtcacttaatcgctctcatttcactagaggacacatgagctcatgaataacggttgaccccttagccaaagatcctctattgtaccctctggagaaaataaatctctagttaccttaaaagctgatctagaggtaaaatgtctgcaacattcagcaatgaatttagattatctttgaaaaaaagttcattttcaagttgttttttttgtttcgtttttttttttttttttttgccaaagaatttctttttttttctgttacttagtagcatgaagtacaatgtttggtttgcaatttctgttctttgtaggaagaaaaactttagtggaaacaaccagtacttaaagaccattttatgaggctgtcatttacgtattatctcttttgctgtttttgttaaaatgatataaggtgggctttatatgctttctgtatatcctttggaatgtgtatttaaattaaaaacttaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttcctcccacccttgaaagtcctcgacttaaaacccatctagaacatttcctttgctaagactttaaagtattctttcttcaagttaagggcagtttttaaatagttatcagttgcattcttggaattcacagaaagcttggggagaaacaatccaacggcacaagttcaagtgcccaacggggtggagaagggactgcatactcactggttgccaggccgaggttgtccgccttgcctgctttggctgagactggagacggaaactccattcaacagcgactggaggactgaaacagggcgcaagagggcggctgcccttcacctaccggtccctccctgccttggcgccttcggagttcggactgacccgggatgttgctggagcccgcaggaactgcaaactcaccgcgcgcgtccctgcacacccgcacctgcgcctcgagaactcctggccagttgaatacccggtcccccgccgagcttcgctgcaggtcacaggaaagaggtgcagggttgcgtacccggcgggagaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggatggagggagggaagaaagatgaaaaaatcaaccaaaaaaagaacatgatttcctaactaatcggatgtgggtcatgagagaaagacctgcgtcgagtttttggcctgaacgtgtggagggtggagttgccattaactaacgtgggaaaaggcaggtgtagtacgttttagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggcgcatctttaggtcggtagtgaggtgcggccgggacgctgcaactcgctccgggacttgtaaacctggcaggtgttcgaagagggccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtaatttctgctgaaacaattgaaggaggaaaaaaaaaaaagtatgtgctttgtggttccctggtagtctagtggctaaagtttggcgctttcaccgccgggactggttgattccagatcaggggactgggtctcggcctcactgtgaggtattgttctttcctgtgtttgccatctgccaccgctgtggctcaattattccaagactgctggagaaatggaattaatgtcgatcctaaaatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatagtctcatgggtatgcttgagactttaggcccttgggacacctggtgcacagaagggtcccaaaacccatctttggaagtgttggcagagtaaataggcaccagtaataaaggcaacggcgcctgaagacctaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttattggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatgtatacgtgtgtgtgtatatatatatataaccatatgtaatttcaaaaggtaaattaaatataatgggacagtgttggtaacctcttagatagtgtagggctaagatagctgaatttatggcatggtgttgtatacttcagatatctatgctgtaatattaaaatggcatttccttggcccactaaattgtccatttcctggcccaaaaagatacgcgaaaggagtgaaaatgggaagaaaatagccttttgaaggacttgcctaataaacttctcccttagcattacttggagtgacatcagaaaattggaatgaagtaattgtgtaatgtaaaaaagacaaattctctgctgtctttctcccccaatccttaataaacaaaggaggaaacctagactcaggttaggttttctcttcttattctttacataccaggacaagtactgagcttgtttgttactatatggggacttagtatattgtacaaaggggtgtggctattactatcccttttctaccagagcatcaaaactggtaacttggctggtgttaacgggagcttctaaccttgaattcccactccatgtgacttctttctggttctctcttctcagagaacttgcagccatcagattcatttggagaagtttgataaaggttactttacgcttagacagaagaaaaaaccctaaggtcttgaactgagccttatcctctgatacagtttactggaattccctccactgtggcacaagccctgctgtaaattgtgattatctataccttgtcagttttatctatgtatatatcttttacagtaatccccacatccaccagagaacctaggttattggcagaatgaggtttgggaattctggtcctctggccagacactatcagttagtactctgattccaccatttttgaaattatatacaacaaattttaagtattgtttattttggagagttcaggttaaaggaaatgaagactattattcagtattatttctgtaattttgtaattttaaccataacataggtttcttatcaaaacgtatggaagccagaaagcagtgaagcaacaatattttctccaaaacgaacaggccaaactttggcaggagtgacaaatctggcatgcaatggtggcttctatatcagaaatcaagtcttttactttgtgagagcacgagtttttagttttttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgccccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagatgcagtagagagacttctttcgttaaagtacctgagtcaggttgaggggaagagaagaattaggagcacaaagagagcaggcacaccacaggaagcacaactctgcaattgcttttggttttaagaggctgtccattcagtttttttgggttttttttttccttttcttgaaacggagttgcccaggctggagtgcagtggcatgatctcagctcactacaacctccacctcctgggttcaagcaattctcctgcctcagcctcccgagtagctgagattacaggctcctgccaccatgcctggctaatttttctatttttagtagagatgaggtttaaccatgttggccaagctggtctcgaacccctgacctcaggttatccacctgcctcggcctcccaaagtgctaggattacaggcatgagccaccatgcccagcctgtccattcagtttcaatgaactttaaacaacaaaaaatgccatttgggtggctggtttcagtcttccctgtcaatgctcagcctccaaatattcactaacacatagaacaataggaggactgttactctcctctcacacctactacttgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacacccataattccacagcatgacaccaaactggagttactagatgacaacccaagtggtgggttgctctgtcaagaaggggccaattttatattgcagctaggcagttacagtctgtagctgtaccattgaggggatcggggcaagatgcaaatttccatggcttaccagaaacaggtgagaaactgcctgctggtagcctgctgcaagacaaggaggcccccaaaagagatgagtaagaaatagtcttatgataatggctcacaagactacttcccttaccatggtccaggagggcatttggtcaaggtttgagtcatagtatggttgagccttgcctatgtaaagtttaagcaaagccattcccttgtaccttgtaccttgaagagagtttcattggatataatatccttaatttgcactttcttctttttaatgagtaaattgcattttattttattttattttattttattttattttattttattttattttttgagatggagtctcactctgtcgcccaggctggagtgcagtggcactatctcggctcactgcaagctccacctcccaggttcacgccattctcctgcctcagcctctggagtagctgggactacaggcacccgccaccatgcctggctaattttttgtatttttaatagagacggggtttcaccatgttagccaggatggtctcgatctcctgacctcatgatccacccaaggagtctctctccctccttgtgttctggtctgtgaatggctcacacttgaacttagtgtaggctcctagtgggaggagcaggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactggtggaagcctcagggcaaggccttcacttcccagtgacactgttcccaattccctccagcatgagctgagcctcctcaggctgtggttgtgcagcagacagggtgtgaggaaaccctgctcaaccctggttacccaggatggcactgagttctaaaaagcaaaggttatgtggtgaggggcctggctgaagacctggtgtggtacttttgtgagcagtggcaccaatagaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaaatacccaacgtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagctggccacccaaccctaatcttcttcttatgcaaatgggttttctactttactcgcaccatgttgtctgctccttactgtacacgtggttagaaaggaaaagggaagatggagccaccatgttgaacatgcctaccccccaggtagccttgtcctattggcacagccgccagcagtcacctgtgcaagcttccagcttgcttatctatgtctgcagctccattttacaggctgctttttgttagaaaagaaattatttggtggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgtcggccttgtaggtgtggggtatctctagcaccagaggatcattgaggttggggatgcagggcagtgagcagatggacaagagaacttttgacagtcaatgctggagaccactgagaccataggatgttgaagcagatgctgccattgctattgatattggggtgataaattttggttgtgaaagcaacctttgggggcttgaacaggcaatccataggaaagtggatggtcaggaagaaaacacctccttggcaaggactgtcattaattatcacccagaggccccgtggagcactgggcaggaggattcgtctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgcttttgtaacttgttccacagtgatgcctggagacctgagtatgttttatctttaaaatctaataatgttactaggatattgtcttgaagttgatcatcctggtttaatttttgctgccactttatgggctctttcaatgtgcctcatcacataagtaatgtcattttcatttttgtaaatcaagtctcctagattgttcacctgaaagcctgattctcctttagagaaaaaaatgctaaaaaacaaaacaaaacaacaaaaaaaacaaaacattatatatcgcattacaattttattcaacaaatacagaggtttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggagagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaattaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttcctcgctccatagtgaggcgtgacccagcggtcagcccaaggtctagcatgcgaatcagggacgtgatggttctttgggattctagggatctacctggagaatagatgaaagtaacaaaagttttacataccaatattcaaaactgcatcaaactaccagaaacacttgccactttcaaagatagactatgctaagtagctccaggtgtgtgccaccatgcctggcaaatttttgtatttttagtagagactgggtttcaccatgttggccaggctagtctcaaactcctgacctcaggtgatccacctgccttgacctgccaaagtgctgggattacaggaatggctcttgactctaactgcaaggtccctagatcattagatcatttcctgaatatcttatgcttcaggcattggccatcacttgggttaccattgtcataaatcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccacaaatccggctcttatgtgtggtcctggagaaacaattgaaatacaatactgaaaaagacagaaattgttccaaaagaagctttttgcagtattgactaaaagctaacagtagacatccaaaaccaaggtttttacagaatacttttactagacaaaactataaatattaaaatagcttatttgatcaaactttaattccgaaaaaggctccttccaactgcgtaacagactcctatagaaaaacatcagaaattcatccaggttccttgtttctgatcctaaatcttcaatttaggacctcaacctcaaactgttgctttagtggctctgggaaggaagcactaactggcagcataggtaagtaaagttttaatctagggaagaaataagaagcagaatcagaattagaattagaagaaagagggaatatgctataccagaatatcataggcaaaaaaagaagacaaagaaagaggaaatgaaaggacagaaggtaatgctaatggagttagttatttgtggccgttttttgtaaaagagtaatgatcagtcttgtaatcattataatactattatttgctttctaaaatgtctaaaatatttgaaggaatttatgatataaaaagatgaataatgcttgcagtcagtgtttcattgtttgggagaacccagtttcctcagttaatacactttcgtgtaatagctgtttaaggagtaacatggtttaaagacatattaatggctgaaatattaacatattggtcttttgatgaagttcaaatagagagatttctttccccaattttccctggaaagattaaactgaagagaaaaatctggaaagtttgccccacatgttgggtctgggagtcattatgattttttcaaagacaggagttgtgtatgacatggaatcatgcttcttctctagttgagaagccaagctaggtccaggctgagtcataaacttgaacccaacaaggaaatcacccttcacactggccttgcagagctttggctcaatctgttctctgcccaacacccaagacacatactagttctggccaacaaaccttcacatattgtctgtgtcaaccagagctacatttattccgaaatctctttctaaaatacaaacctgtactttctactctcaaccccaaaatttacaagaggcctcatatgcatctcagagtcacagatgctaaaactcaacacaccagtgagttccctgtcagcatcatatactaccctctacctcaatgatcagccccaagccagcatctcccaaagagtagtgtgttgctgtgggtgtttcaacagatcactaaaacctgcttctacccctgcctagacacttatcctcactgctatgcatcctgctcctcaaatcagatcttgatatcttctttaaacactcccaatctcccaacacgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtatcctgagtgacctttccacagtgtaaatctggacatacctgtagccttaaatcatatctaccaacatagtagccaagcaacagcaatctcttttcctttggtcattagagtcctagagaccaagaggatgttgggaaaagaattaccatggatcagctctcagaggcagtaggttctggactcatgctggctttgatacgtgtgcattggaaaagctcaagtacctggcaatacttggagattaggaagaaaggatgaaaataaaccactgcactaaataacatgacaataatcacttatacaaaaattttaaagataaggaatatttaaagatttattagtttattatagctttatagttggagagtgaagaagaaaataccaaagctttttgtcttaacaaaatggtgcagacagattaacatatattgtcacctatgataaccagtcagcataaaaagtatttagaaaggaatggttatattctctaagagatatattctgatgtcatgttttttgctttagagtctattaatatagccacctttttgttaatgttttcagtcaagctccttttctcgcctttcatttccaacctttctctcactttctggtttagatacaactcctaaatatatcatatagttaatttaaaaatccagtgtagcagtatttcgggggtttgttttactggataatttggtccacttacatttaatgtaattgttgatatatattaattttaaatctaccatctttatttttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatccttaatttttttttttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtaataattgataccgttatcctcttcctgcacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttactctttatttctgctatgtctctgaatttccatatgtaatcatggtccttctgcctgagaaacatcatttagaatttccttttgtgttggtctgcttgtgaaaaactgtttcagctatttttctctgaaagtgtctttatttgctttaattattggagattatttttactaagtatgtaattctggaggcagttattttctttcagcatattgaagatatttacatttgattgtttcttttcagaaggcagccaattgtctcgctgctgcttatttgaatgtaatgttcctttttttcctctgttttttgtctttactatttttgtctttgtttttttttttttattgtctgcagttttactactctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaagtagactttctcactctatttgttatatttttgtgtttgtgtattaaatattattttttctccttgttatatattctgaatttttttcttcttcctcatctcccactttactagttctcttttcagctgtgactgctctcctgttaaactcttccattgagctcttaattttgttttgtttttttttttccgaatttctgtttgcctctctctaaatctattctgtcatttttttgttgtttccaattggtgtgtaaattgttaacaaaacccttttctccttctgcatgataatttgaccttaattaactttccagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctgatagcaagctataattcttatcctacatctctcggattaatctggtgccaagtatggcctctgagattcttgtgagcctgaacgttaacttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagttcatttttatcccaagattatagaaatgtaaggtcctaccttattgtaggattattctcctgataaactccccaacttgggcagactctggtcttctatttctgtcccattagtcacagaaggctgtcaaaccctaatatgcaggtcaggaaatgtccttagccaaaaaatggcttctctgcttgcttacggctctgggttccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgttcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatttgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactatgctgccaaagtgactcaaactcaaaaggacaggatgagacttactcagaacttcgaggaagtgtagagaaattatccaccactttttatcctagaggtgcttttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaagagtcaagtctatgacttacaagcttataaagatccctcagatgagttatgtacatggattgagaatcagaaaaggaaggatgctctctcaggagatagaaaaaccagataaaaggaacaactgaaattatctgacccatcccctcatcgcctgtgtagaagggaaatgcttactttatctaaccagtggataacagacagcctctttcattttggagctaccaaaaagaaaaataaattgtggtttggttcagttcccttttgaccagtatgttcttgaaatttcgaaaacattttactctttttccttttagtgtttcagtgtggataatttcatttgatctattttcaagttcattttttaggccaaaatttgtcaaatattggcaatttcatatgattcaacttaatatattaacctaatgtgccaaattcaaatttgtttctatactactaaataatatcccccgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttatttaagctttatatatttactttttacctgttaattgttgtaatcacccactaaagagtaaattctggctgggcacagtagcttacgcctataatcccagcactttggaaggcccaggtgaatggatcacttgaggccaggagtttgagaccagcctggccaacatggtgaaaccccatctctactacaaataaaaaaattagctgggcatggtgatgcacacctgtgatcccagctacgcaggagactgagacacaataaacgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtatcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatgtaggaggatgtgtatgaatgagcatgtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcctttcttacaatcccggagccagcctcatggccccctctcaaaggcatgagcatcagccagtggacacctcttcttcagagatctgagtccctgcgacactaggtacttcctctgagttccaaggccaccagcaacctccttctcagaagccatcctcccagttatgtgtggcccttcatccaagttaccaagttctaacaacccaaccattttacctttgtttctacaaccctagggttgatcactgcttcgctttctacacttactatctctgtgttacatcagttccccttttgccttcttagacctccaatacctgtataattccttgtgttaaattccctctggtatactgttcattttctatttttttttttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgatcctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaagagacttgattaactcacagttcagcatggctggggagccctcaggaaacttacaatcatgacagaaggagatgcaaatacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttcccaaaagtcccccaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagagattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactatcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagatcttgtcctctgcacacctgcaggaccaacaccatgtgaaagctgccaaggcttggggctcgcacccgctgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagacactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagactgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaaaccccttataaaaccatcagatctcgtgagaatcattcactatcatgagaacagcatgaaggtaactggccccatgattcacctacctcccactgggtccctcccatgacatgtggggattatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttgtaaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaaagaaatgaaaaagcaggaacacatgatagggtagtctgagctctgtacaaataggaacagtaacatagacaaggagtaattagagtaggctgaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaacattattgaatttttatctaaatgtgatggaggatggacaggaagagaattactgattactctcagtcaggattcatcctagcagcaattatttgtaatttaactgaaataagtccatttgactgaagagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaattgttatacacccttcctcacagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattattttattttattttattttattttattttattttattttattttattttattttttgagatggagtcttgctctatcacccaggctggagtgcagtggcacaatctcaactcactgcaacctctgcctcccgtgtttaagcaattctcctgcctcagcctcctgagtagctgggactacagatgcatgccaccacactcagctaattttttgtatttctaatagagatgaggtttcgtcatgttggccaggctggtcttgaactcctggcctcaagtgatcctcctgcctcagcctcccaaagtgctaggattacaggcattagccaccgtgcccagcaattcttttggaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagactgccatgtaggaaacaggatgtctctaaagtgaaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacaaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtacaacatctgctactcctaccaaatgctaagccactatgaggatataatgctttatttttatttatttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgtttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacgtgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcgcagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaaatttttttcaaggaatagaaccactgcacatgctcctcctgatcccccaaagtgtaagattttcatgcaaatagctatctcccaggacttacattagtaaggtatctggatataaaaatcagtgttccctaaatcagctgtgtttccattatatcaaaaataaacttttagaaattaccatttgaattaacaaagatacacacacacacacacacacacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatcatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagaaatagacaaaagtgcccactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttcaggccatgatgggaagggggagctgaacatgcctcatcataccctcctcccttttggaattactggtagaacagactctaagtctgataaaaaaaaaaaaacatttacaatctattctctctgaagtctgctgcctggatacctggaggcttcatctgaatgacaaaaccttcgtctccacaaccccttatcacaagccagatattcctttctattgataataaggaattgccaatcagaaaatctttgaatctgcctatgacttggaagccacctcacccctgcctgctgcttccagttgtcctgcctttccaaactgaaccaatgtaccttttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcacatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcagtaccttttaaagatgttgttgctacattgtcttctcacttgcattatttccaacaagaaatctgatgttttctttgtgcctctgtgtgtagcatgtctttttatctccgatcacttttgagattttctctcactaactttcagtaatttgattattaaatctttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagatagattaacaagagaaaagcagataatcagggaaaaatgagtaactctcaaagaggtggcctagaattttggcttatgtagcatcttcaactaaaagaaagaaagaagggtgttgggaaagcaagctatgggaaagtgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactccgagagggttcttggatctcatgcaaggaagaagttggagtgagtccatagagtaaagtgaaagcaagtttatttaagaaagtaaagaaataaagaatgactactccataggcagaccagccccaagggttactggttggctatttttgtggttatttcttgattatatgctaaacaagggttggattattattcctttccaggaaagggggggtgcaattccaggaactgacagttcctcctctttttagaccatatagtgtaatttcctgatgttgccatagcacttgtaaactgtcatggtgctggtgggagtgtcttttaacatgctaatggttataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcatttttttttaaccctctgtttcattttggattgtttctattgctctgtctttgcattcattaatcttgttttctgtggtctaatgtgctctcaatcccatccagcatactggtattcatctctagaagttggcttttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacatgcacctgtgaaattaaaaaaaaaaagaagaagaaactttttatctgaggaatgtgagcccctttaaattatcaggctcggagaggcattggaatgaaactgcagtcacatcactcccccttgagtgattatcttgtaaagccacttgctatacgggctccagactaactgatgccaagcagccataaaataccatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtaggtgaggcaattgcagggctcatcttttttcttccctatctctcaggggtgactgtcttttgttgcctgatgtccacagtttcaaaaaacattgtttcatgtattttgttcttttgtttaattttgtttaattttgtttcaggtgagaggataaatccagtctctgctactccatcttggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatacactaagtgagggtctttcagaatagcgcttcagtgtctgcacctgactcacactattaggcagttaaaagctggggaatgagctcatgtgaagagtttttccatttcagatgatagctatttttaggaacacaagctacataaatgttttaacccttttcccatccttttcctcttgctgctgtgatacaggaagaaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacatattcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaactcctgggctcaagcaatccacacaccttggcctcccaaagtgttgggattacaggcatgagccactgcacccagcctatctcatcttttaaaaaaaacatatcaaataattgttcataaatcattttctgtagtagagagcaatttttcttaaaattggcaaataagattttgcatctacctttgagaaaattgtatttgtaaagtgattttaaaagaatgaagcctatgagtatgatggcattataaaagtatcagtggccaggcgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaagtattaatatatggaaatacaaatgtcatatatagatgtaaattctcctaattgttcttctgagcatcatgatttttttccatgaatttttattttaagttccagggtacatgcgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcatggggtgggcactgttatactccatcagtgagtacgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagtgatgaggataatgatcatagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgctcgtatagcaatcctcaaatctcagtagcatataaaggtaagcatttagttctcacttacaagtttgcagggcaggtgaggcagctctgcctcaagccacaatgtctaggacagctctgtttcgcactgtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacataccctcatgaggctgtggagagagtgtagattcagggagcggtgagaaactggggccagtacaccaacttacagcatgatttgtcatcatttttcattctctgctagtaagattgccaaagtctctctgcactcattgaattcatttagctctctttagctctctttttttagctctcatttagtttccatttagctctctttctctcttaccacaatacctaaaaatctttttatggggttacaactctgtctcaggagccacctcagtttggtggcacagagctccccacttgtactctgaaactcttttcttgaagatattgctatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagaaacttctggattcaaatgattgtttggaggcattagccaggcattgaaccaattataaagagtgaggttttgccatattctaaccgtaagaaacagaaacggtagagggtaaaaatagaatagaatgtcaatacaactttagccttttccctggattctgagagttcataacctgaaaatcagagattcaaactgggagagatgggctaacaggtatgagcatgggaaaagcatgtttcaagaatttgagatgtatttcccagaaaagcaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagaaggcaaaagaaaatattaataaatgaattattacgcacataatgttttgtatgtacatgtgtttacttttaatacaaaagtaacggactaagttaacatagatgttccaataagataatttatgtttcatttttggcttcaagtatcctcagggttataagtatcataagctgagaccagctgaattggtttgtgggttgatgaggccctatgcctgatttgaatttctcttgaatggtctgcagccctggaccaagttgaagaagccatgagagtctcagcttttttccttaccccattatgagataaactcattccttaaatatcttgctcatttgataaaacttggcacctttctcctttctactggtccctaatacttactacctgtactgtaagctcaaattttttgcaatttctgcctttattatgtaacgtattccactggaatatgtgttacaggaaaggggtcccgatccagacccctagagagggttcttggatatccagcaagaaggaattcagggccagtccataaagtgaaaacaagtttactaggaaagtagaggaataaaagaatggctactccatagagagaacagccctgagggctgctggttgcccatttttatggttatttcttgattatatgttaaacaggggtgggggggtggaccacgcctataatcccagctactccagaggctgagacaagatcatttgaaccccggaggcagaggttgcagtaagctgacatcgctccactgcactccagcctggaccacccagggataatccgtcccccgcaccccgcccccccaaaaaaatcactgccagtaaggaacaaacagccaggacgaagtactaagatgtaaagagatgtaaaatagcccgggcgcggtggctcacgcctgtaatcccagctctttgggaggcctaggcgggcagatcacgaggtcagaagatagagacgatcctggctaacacggtgaaaccccgtctccactgaaaatatttttttaaaaaaaattagccaggcgtggtggagggcgcctgtagtcccagctaatcgggaggctgaggcaggagaatggcattaacctgggaggcggagcttcaagtgaacccagatcgcgccacggcactccagcctgggtgacagtacgagactgtgcctccaaaaaaaaaaaaaaaaaaagaaagatgtaaaataatgtgatacattctgcaagagttatgacagagtcagaaaggggcaagcatgtttcttctctaccctgaagcagccaagggagaagaagatatctgttgccaacgctggggtgttacaagtgcacactgccatgcccggctaattttttggattttagtagagacaaggtttcactgtgttgcccaggctggtctcgaactcctgagctcaggcaatccacccgcctaggcctcacaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtgtaagtatgtccatttacagattgggagatggaggaatcacagagcggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgtgcgcctgtagtctgagctacttgggaggctgaggtgggaggatcgcttgagcctgggagattgaggctgcagtctgcagtgagttatgatcacaccactgcactccagcctgggcaacagagaccctgtcttaaaaacaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacgaggaaaattagagttatcaatgattttgggggatgagtggagtgtagttttcataggctcaaagcaaagcagggctgtgtgaaagggtaggcataggatgggactttgcagtggatccagggtcttgtttcctcagaaactacaacgttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggagaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttatttcccccccctttaatctatattttattttatttattttttacttttttgagacggactctcgctctgtccccagggtggagtgcagtggtgcgatctcagctcactgcaacctctgtctcctgggttcaagcgattctcctgcctcattctcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggtcttcccaagtgctgggattacaggcatgagacaccgcgcctggcctaatctatattttaaaaattgaactcttccatgtacccctgaacctaaaataaaagttaaaaacaaacaaacatacaaaacaacaacaacgacaaaaaaaaaaaaaaaaaaaaaaccaggccgggcatcgtggctcacgcttgtaatcccagcactttggaaggccgaggcgcgcagatcacgaggtcaggagttcgagaccagcttgactaacatggtgaaaccccgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaaaaaaaaagagagagaattctgtactttgtaattagaggggtaattcattaattcatgtcaggggcatattattttatttttccaaatgctaggaagcaggtatccattttttgataatataaattttgggataattggcagtcatctggctcacagggaaaacaggaaaaacaagaaacctaaataaacttcatattgatttcccaaaaaaattaccttttattttcaacccttatagaactcaacctgcatctctttgccatccatgttctttttttttagagactgggcctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttggacctatataagaatttcttttggataaaaactcaggaacagaagtgctgagaagccagaaaccagcagttctgttcagagttttatttacatctaattgaactaaggagtgtcaggctcccctccagaatgcttgtcccggacttccaataccaaggtagctggactctgagcccacatccaggcccagtcctcgggtcatccaactttctaagttttgccagactgcctggtgtaaagtggtatctcagcattgctttcgttttcattgttccgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattttttatttatttatttattatttttttgagacgaagtcttgctcttgtccccgaggctggagtgcaatggcacgatcttggctcactgcaaactccgcctcccgggttcaagtgattctcctgcctcagcctcctgagtagctgggattacaggtgcctgccaccatgcccgactactttttgtatttttagtagagacggggtttcaccatgttggccagactggtctcaaactcctgacctcaggggatccgcccccctcggcctcccgaagtgctgggattacaggcgtgagcgaccgcgccaggcctcaacctacatttcaagtcaccatctgtcacaggataccttccactctggctctggatatgggggtcacctcctcacaaagacagacaggctgtatgtgcatacacagaaagattcagaagaaacatgaagacttttaaaatcagtgagatgattttaactttctttaaatcagtgagatgattttaactttcttctttgtagttttctctagccagttttaaaaactgtaagttgtaggccgggcgcggtcactcacacctgtaatcccagcactttgggaggctgaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgaggcaggagaatcccttgaacccagaaggcagagcttgcagtgagctgagattgcgccactgcactccagcctgggcgatagagcgagactccatctcaaaaaaaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgttgttgagacggagtctcactctgtcgcccaggctggagtgcagtggcagatcttggctcactgcaagctccgcctcccgggttcacgccattctcctgcctcagcctcccgagtagctgggactacaggcgcccgccacccatgcctggctacttttttttaattttttttttttttttgtatttttagtagagacgggttttcaccgtgttaaccaggatggtctcgatctcctgacctcgtgatccgcccgcctcggcctcccaaaatgctgggattataggcgtgagccccagcgcccggccaatgtaaatgtatttcttactgtagacttgaggtcaggagagtgggctgtactggacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagccttttcttctttccagggttgttgtggactcaaacgagaggctgttagtgaaaggtttttgtgagttatgaagctcctaggaacccaattatttctgctgccttggccacatagtctagaagaatctctacataattagcatctagagactagataatttacccattattttccatgtgcttgtcttatttcccagcatgacggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgtccaaccattcaggcttttcattattataggaagcatctggccaaggaccaccaccatcttcctgtcctgcccctgaagctgtgagttccccaagtggagacacagcctgttccccaacacctacactcatgaacatgggagggttggtcaaaattgcacagctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaactaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctccctttttttttttttttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgccggctaatttttgtatttttagtagagacggggtttcaccatgttggttaggctggtctcaaactcctgacctcaagtgatccagccgcctcggcctcccaaattgccgggattacaggcatgagccgccgcgcctggccttgctttttctcttttaaaattactgttactcatggggtatctgcaggcctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattagggatgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtccacttgcaaagacgacagatctctctacaaattctgggctgagcaggtgaaggaggctggtcaggcccatgaaggagcctagtcagccgtaaggaaaggttcactgtggggcccccgactttccattcctgatctcctttttacctctgctgcccacttcctttcctctttccctccaagtataccttatactctgctcctgatgacactcagatctccccccgcccccccgcccccatcaaatataaagagcctagtgacttttgtaagaacggtgtattcatttcctagtgttgcattaataagttaccataaacttagtggtttaaaacaacacaaatttgccgggtgtggtggctcacgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactccgtctcaaaaaaaaaaaaaaaaaaacatgaaaccaaacaaaacgaaaaaaaccacacagatttattctcttaccattctggaggtcagaagcccaaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagattccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgagaagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcccagtctgtaaagtgagaatgataaaacatctgccttccttgcaggattgttgtggtgatgtgtaagacaaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatcagagtaataacaactggtggatgtgttctcctaggtagagaacaggaatctcaatttttaatgttgggagggactttatgcatctttttgctttcaaaagcaatttctggctgggcgtggtggctgatgcctgtaatcccagcactttgggaggccgaggtgggtgaataacttgaagtcaggagttcgagaccagcccagccaacacggtgaaaccccgtctctactaaaaatacaaaaaattagctgggtgtggtggcaggcgcctatgatcccagctacttgggaggctgaggcaggagaatcgcttgaacccgagaggcggaggttgcagtgagcagagatctcgccactgcactccagcctgggcaaccgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaattttttctttctttctttctttctttctttctttctttctttctttctttcttctttcttttttttttttttttttttgatacggagtcttgctctgttgcctaggctggagtgcagtggtgcgatctcagctcactgcaagcaccgcctcccgggttcacgccattctcctgcctcagcctcctgagtagctgggactacaggcacccgccaccacgtccggctaattttttgtatatgtagtagagacggggtttcaccgtgttagccaggatggtctcgatctcctgacctcgtgatctacccgcgttggcttcccaaagtgctgggattacaggtgtcagccaccacgcccggtcaatttttgtatttttagcagagaggaggtttcactgtgttggccaggctggtctcgaactcctgacttcatgtgatcggcccaccttggcctcacaaagtgctgagattacaggcatgagccatcacgccccgccctaaaacaccaaatcttattaaatctatattctacaactctgtcacatccatcacttcatctctgcccactcctagcactgacttagctgaggacatcatcaattctgatcaaaggaccctaagtctaagtaacaataccactttcatggtaggctttccccggaaccagctggacataatgagaattttcaagagaatgtgaattgctctttacttgattttctttttttttgagatggagtatcgcttttgtcgcccaggctggagtgcaatggtgcgatgtcagctcactgcaacctccacctcccgggttcaagcgattctcctgtcagcttagcctcctgggtaggtgggattacaggcgcccgccaccaagcccggctaatttttttttttttttttttgtatttttagtagagatggggtttcaccatgttggtcaggctggtctggaactcctgacctcaggtgatccgtccgcctcggcctcccaaagtgccgggatttcaggcacgagccaccgttcccggcgattttcttttctttaagactaatctgaaagtgcggaactctgtgtacctgaaatgattacattttgatattgacatgaaaaaattgggtactactttgccccagtttctcaacccaacaaagacattccaaaagtttcctatggggcctaggaaggttggccttcacaggatagtggcaggagtgttaactttgtcctattaccaaaaggtgtcaaagctgttactaaattgtctgtgtcagtatcggaaaccccgacagcactggagaattcctcatggtccttccagaccatggtcacagtgagaagcagattctgttgccctggccctgtggggaaatccccaagatggctgctgatagttaaggaaacagtgtcctgccatggcctgaccctaggctgggtgagagagagtgggtcagacaggctgcacttcctcagtgagtgtgcatacacctgttcgcactgcctatcgtttcctcacccagtgtgagagcagggggctcagttgggctgagtggagaattcatgggacctttccatggtcaaggcccagagcttctattgtgtagcatccctggaacagagaacaggaggcagtcacaaggccccagcttcaacctttgacagtacaccagaaaagaccaagtagtgaggcctccactgtctcacaccagccaagaaagaccaggtcttagactatccagtgttcctgcctctctttcacggtgctgtatctggggaatgaatactccattgtcataggaggggcagatgcgggcggaagactcagaagggtcaaggtaggacatagacattcccactaagctagagacccctgaactgccatagccatgacatgcacacgttgtcctcaaatcccagggccatgggcaggtcttggatatctttggaattttaagttggttggcatctgtctagttttaaacctgatttaggttcagttcaaccagggagtatgattctttggggagagggccctgacctagaaatctacatgctcagcggtctgctcagccactaatggctctgacacactggaaaggcactcaccctctgggagtttcagactgtatctttgaaaacaaaattcagtggatggggtgcaaaggtattgtcctcaacagctctaagttactacttctaactcacagagcacatatcacaaaggatcccactatccattgtcggtctgagcagggaatgagactttggcagaccatgaatcctgtattaatttctagggggactataacaaaataccacagacttgggggtttaaactgagattgcaccactgcactccagcctgggtgacagagtaagaccctgagtcaaacaaaaaaaaaaaaagtgtatacatgggagcactctgtgatgagtaactcaaaggagtggttagaatttgggatctacctagcagcaggggaaaaggaggaggagtaaaggacatatggaaaaccaaatgacttttgaaaagataaatgggcccttagaatagatggaagattcgagtcttgtgacaatgtctatttgggtgtggtgaccacttctcatctccgaggttagatttgcttctagtgctgaagaagatttatgacaactgagttaaaaatttgagatttgcgaggaggatctgctattaaacaggtaagggattttagctgtttgtttcagctgaaaataattcttaagtcgaaactggcacatttggaggtagcatgtcctgatccccttaaaaagggaactgcacagacaccgtatctctgattctgcccagggtcctgtgccctctgacaccagaaatcaccacttctctcagccttgttttgcggttgttttatcatgttgcaatttggttatgtcttttctaatagtgtttaaaagcaatcaaaggcaggaacttttccttttataaactattgttgagcttatattggacactgaactaagtgtcagtttacaaaaatgaataaacaaaaatcactgccagtagggaacacacagccaagatgggggagtagtaagatgtaaagagatgtaaaataatgtgatagattcggccagagttactaaagagtcagaaaagggcaagcatgtttcttccctgtcctgaagcagccaagggagaggaagatatctgttgccaatgctggggtgttggtttaggcatgtagatgctgtgatgcgcagtggaaccgttcaatgagcagacaggagaaccagctttatgcggggagggagagaattgctcccctcatcccccgtgagtcacaccctggagattataagtttaaacattttgatttcgggagattttgagttttgggcttaaaatgactgaagaaccaccaggtggatctacgtgtctcgagtccagaagtctgaatacagatttacgatttatgagcacacagaaggtggatccaagggagagattaaacagggcacagaagagtttttaaaaataatatttttcgggaaaaaaaccccaacaaaacacgattctttcagcagaaaccagaagattttctcatagactctcctacagagagccctgataaagtaataaacatgctaacagtaagaaccccaaccaatttcatagggcagtttgcggtaactactcccagtatggagcagacagtcctcttgcaaaacccgatttagcaaactttgctagctccatgtggggcctccaaaggacacagctgggcactaaatcctggctgaaaacaaaggccgatttagaggatccgtagaaacggatgcacagaatatccctcagtcttctctatgtagcaggccctccatatacgcgggttccccaagaccgaaaatattaaacaaatgaatttcttttttaaaaaaaagtacaacaaaagatagtaaaaataaaaacagtataacaattacttacatagcatttacactggattaggtgttacgaagtaatttagagactatttaaagtacacgggaggatgtgcatagttatgtgcaaatactacgccactttctatgagagacttgagcaacctggattttggtatcggcgggggccctggaccaatcccctctcagttctaccgagggagaactgttttgtttcttccagcacggctttgaccgacagtgtgttgggattcgctgacgtccatgagaaagcttggcagcatgctgagaccaattttcccagggccagaattctcctgtgtgagctaaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaacctt
